United States Patent 9,828,416 (MODIFIED POLYNUCLEOTIDES FOR THE PRODUCTION OF SECRETED PROTEINS) - sequence listing, part 2

SEQ ID NO: 567 - DNA, 2966 bp, Homo sapiens
acgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcaggactgagggagctggccgtgcgactgggcttcgggccctgtgcagaggagcaggccttcctgagcaggaggaagcaggtggtggccgcggccttgaggcaggccctgcagctggacggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccaggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggca

SEQ ID NO: 568 - DNA, 1669 bp, Homo sapiens
catatttccagctataatccatcatatttccaggtgtatcccttcccttaaaagtaaaaaaggagaaaatcactttgctgtgtggaagtgctttgtgtgttttataaaatccacataaaatgttcgtggttcaaggagtggctgccgcatttctaaggcaaataagcttatccctgaagaagcttgaagatctgactctcaagaatctttgtgttctggatgaaaaaggaatcattattttttaactcccctgctcaagtcagtgacttccactggcacccaatccattggttataagtacccatgaattgccttgccaattataggcaggataacctaggaggaccaaccaaaaccaaactcctggtaagctttattagccttttctacaatgtgtctcagtttctctttcacaccttggagtggaagacaatctctactcacactgttgtggtatgtgtctgtctgtctcagatgtgtgtataaggtgtatttctcagctcggtatctgaagtaatttctttttcttttcttttttttaaagactgctgtcttaaggcttaaaagtaatttaaggttttgttttttgttattttaagagttgcagtttctttggagacaacaaagtactttttttccaaagatgaaaaaggcatattcagactttctatgttatgttccataattgttttgcttatcactgtataacattctcattatcatgggctactttaagctaatcagttgcattttggggtcctcatttagaagtcaatctggaaaaaagatggctgtaaaacttagataaaccagtatgctatttctccttccttgtctgcctttacagatgtttcctctttctctctctcttccctgactatctctctcaatgatcattgacagctcccgcatcccctctttcactcagcttcactccaccatgaccagagcacctctcctgctactatgtgttgccctggtgctgcttgggcatgtgaatggagccacagtaagaaatgaggacaaatggaagccactcaacaaccccagaaacagagatctgtttttcagaaggcttcaggcatattttaagggcagaggtcttgatcttggaacatttccaaatcctttccccacgaatgaaaatcctagacctctctctttccagtcagaacttactgcttctgcatctgcagattatgaagagcagaaaaactcctttcacaattatctcaaaggctgaaagtttcttctgagctcaggtgtctggctattttaaaactacagatgaagcttctcattagaaaaattcaaccattgtcatagctaaactttcatggagtttctttccccctcacttttatttttcagtttgtaatgattttattccacatttccatatttacatataaatcgctggaactatgatttctatgcatatttatggagtttttttcctatgaaaccataaatattgatgtagagcaccgcatgtatttgtaggagttacaaaaacatcacaaactgaaaaaagattataatctaaattagatgtttctttaagcttgtttttaaaacttgtcttttatgtttattatcttttatcgaccaatatatttttttaaagggacatgctcacttttagtatagtaaaattcattatatgtga

SEQ ID NO: 569 - DNA, 5575 bp, Homo sapiens
atgcggcacggcgtcgcctgggcgctgctggtggccgcggccctggggcttggggcgcgcggggtgcgcggcgcggtggcccttgccgacttctacccgttcggcgccgagcgcggcgacgccgtcacccccaagcaggacgacggcggctcggggctgcggccgctctcggtgcccttcccgttcttcggtgccgagcactccggactctacgtgaacaacaacgggatcatctccttcctgaaggaggtttctcagttcaccccagtggccttccccattgccaaggaccgctgcgtggtggcagccttctgggcagatgtggacaaccggcgtgcaggcgacgtgtactaccgggaggccaccgacccagccatgctgcgccgagccacggaggacgtcaggcactacttccccgagctcctggacttcaatgccacctgggtttttgttgccacctggtaccgagtgaccttctttggaggcagttcctcatcccctgtcaacacattccagactgtgctcatcacagacggcaagctctccttcaccatcttcaactatgagtccatcgtgtggaccacaggcacacacgccagcagcgggggcaacgccactggcctcgggggcatcgcagcccaggctggcttcaacgcaggcgatgggcagcgttacttcagtatccccggctcgcgcacagcagacatggccgaggtggagaccaccaccaacgtgggtgtgcccgggcgctgggcgttcagaatcgatgatgcccaggtgcgcgtggggggctgcggccatacaacgtccgtgtgcctggccctgcgcccctgcctcaacggcggcaagtgcatcgacgactgcgtcacgggcaacccctcctacacctgctcctgcctctcgggcttcacggggcggaggtgccacctggacgtgaacgaatgtgcctcccagccctgtcagaatggtgggacctgtactcacggcatcaacagtttccgctgccagtgcccggctggctttgggggacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactgcagctgcccctaccgcttcactgggaggcactgtgagatcgggaagccagactcgtgtgcctctggcccctgtcacaacggcggcacctgcttccactacattggcaaatacaagtgtgactgtcccccaggcttctccgggcggcactgcgagatagccccctccccctgcttccggagcccgtgtgtgaatgggggcacctgcgaggaccgggacacggatttcttctgccactgccaagcagggtacatgggacgccggtgccaggcagaggtggactgcggccccccggaggaggtgaagcacgccacactgcgcttcaacggcacgcggctgggcgcggtggccctgtatgcatgtgaccgtggctacagcctgagcgcccccagccgcatccgggtctgccagccacacggtgtctggagtgagcctccccagtgccttgaaatcgatgagtgccggtctcagccgtgcctgcatgggggctcttgtcaggaccgcgttgctgggtacctgtgcctctgcagcacaggctatgagggcgcccactgtgagctggagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttagggccctgctgcctgggaagaggtacaccatccagctgaccaccctcagtgggctcaggggagaggagcaccccacagagagcctggccaccgcgccgacgcacgtgtggacccggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacacgtccctggcaactgttcagaaaacccctgtcagaacggaggcacttgtgtgccgggcgcagacgcccacagctgtgactgcgggccagggttcaaaggcagacgctgcgagctcgcctgtataaaggtgtcccgcccctgcacaaggctgttctccgagacaaaggcctttccagtctgggagggaggcgtctgtcaccacgtgtataaaagagtctaccgagttcaccaagacatctgcttcaaagagagctgtgaaagcacaagcctcaagaagaccccaaacaggaaacaaagtaagagtcagacactggagaaatcttaaggatttaagacgttcttgttacactccaccaacctcacgagtttctaacacccaggaagatgaggtctaaaaactggatgaaaaaggacaccctgagaaaaggtcctagctggagtcagtcccctctgtgacctctctcctcaggcctctagaggacagatggccaggcctgtgcacacaccagcccaccctgagagacccctctgggaccaaccacctgtgagtcctgcgatgcgtttaagcagcctgtgccctcacccaagctgcagttcctgaaggtgtagtctgtgtctctgcggatgagatgacagctcgccattccccggaatcagtgaggctgtcagtcagccacgcttctgcagtatgcagaaacctgttcttagactccaaagccagagaaagaattctcccttcgaggcccaacaaattgagaaggaactgtgatggaccacttccaaaacagagacgggggcaggggctgaagggcagagaccaggtgatgtcagaaggaaagccgggttgcagacacagccgcccctgctctggtcctccagcgtgtttatgacgctcgtgcaggtcgacgagccatcctatggactagttaacactaaggtggagttcagacttttttagacaacggcgcgactggcagcctttctctatcaagggtcagacggtaaacgttttcagctttgcagaccagaggtccctgtggctacagtagcgcagacacagccacaggcatgtcattgaatggctgcggctatgttccaataaaaacttatttacaataacaggtggtggccaaattggcccatgggccttatttggtgaaccctgttctatgagatcacctaggcttcagccttaaacagtggaagccatcccctgaatgacaagtcacaagggtatcaaagaaagacccctgaattttcatggaaaaagctattcagacccctgcttggaaagctaaggcacactgccacgaagcagcaaggacgccttacaagtctcagtgcaacagagatggacacctgggctgggctggacaatgtttaaggttccttttagtccatgactcaagtgatactgttttaggctatcaggtagtaaacacgatcttagacatccccatctttgtaagcagaacagtacggcacttcaccacatctgcttcccaccatgcttctaagcagctgtcttccccctgctaatgttacaaccaaagcagccaccccacctcctctcgtgttgagcctcacgaccgctgacccagctggaaagccagcgccctgccgcgtcaccctgactctgctcagagccagcattccagccacaaagagggcctccttcctttcctctttcataaaaatgttttttgaagagttagagtatattttaggctttttatctttattaaaatttcatgtgc

SEQ ID NO: 570 - DNA, 1400 bp, Homo sapiens
cccatcccccggactccacccccagcgggaggccacggggccgctgtgcgcacgcgccgccgcacaccgggggctctcgggcacccgcgcggcgccggttggccttcccggcgctcgcccgggggcgcgcttgcgcgccagcggctgcggacaccagcctgcgtccccggcgcggcgggccatggaggccctgaggagggcccacgaggtcgcgctccgcctgctgctgtgtaggccgtgggcctcgcgcgccgccgcccgccccaagcccagcgcctcggaggtgctgacgcggcatctgctgcagcggcgcctgccgcactggacctccttctgcgtgccctacagcgccgtccgcaacgaccagttcggcctctcgcacttcaactggccggtgcagggcgccaactaccacgtcctgcgcaccggctgcttccccttcatcaagtaccactgctccaaggctccctggcaggacctggcccggcagaaccgcttcttcacggcgctcaaggtcgtcaacctcggtattccaactttattatatggacttggctcctggttatttgccagagtcacagagactgtgcataccagttatggacccataacagtttattttctcaataaagaagatgaaggtgccatgtattgaaagtgtgcgtcaaagaacataaatatcagtggattttctctgtgtatatgtgcagtatttatttttgatcctttaaaataaaacttttgcaaatacttttttctttctacagtatctgcttctttaagatgaatcattgccctcaagaggtgaagctttttatacatcgttatatattacatactctgtttagctgatgtgaactacaaacacatgaagcttcacaccattttttccctagaactaggttaacctacagataaaaaatgattacaatgtaatagattctatagttaattaacaatttaaatcaactctgaagagaaaatatagatgcccacacaaaagagaaggggggaaaatcttttatgtaacaatggaaaaagaagtagaagacattaggatgtatgatggaaatattacatcattggcaaatccaaaattgatgagaatctaattgtaatctcaagtctaaaccattcagctgccaggattgtaaatagaaacgttttaaaggccttgtgccatttacctggaggaggggttggagtgtaatgttgaaacttcttgttgcttaaagagtccaaaaccatatcgtttgtaaaatgtaataataactggttaatataagtgtagcaaggtgaatgaaactcagacttattaaaagttaaaacagctttcctataaagctgtaagaacaattaagatcttctagaaagatgcagaaaaataaatttggtaactg

SEQ ID NO: 571 - DNA, 431 bp, Homo sapiens
cagctcctgagactgctggcatgaaggggagccgtgccctcctgctggtggccctcaccctgttctgcatctgccggatggccacaggggaggacaacgatgagtttttcatggacttcctgcaaacactactggtggggaccccagaggagctctatgaggggaccttgggcaagtacaatgtcaacgaagatgccaaggcagcaatgactgaactcaagtcctgtatagatggcctgcagccaatgcacaaggcggagctggtcaagctgctggtgcaagtgctgggcagtcaggacggtgcctaagtggacctcagacatggctcagccataggacctgccacacaagcagccgtggacacaacgcccactaccacctcccacatggaaatgtatcctcaaaccgtttaatcaataaagcctcttccg

SEQ ID NO: 572 - DNA, 4450 bp, Homo sapiens
cgggcggacgagagagctgcgagctaacgggtccggacgacggcggcggcggcggcggcggcggcgacggctttctgcgcgggcggcggcggcggccggagcggcgagcatggcccgcgcggcgccgggcgctgactgagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatgatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacgagactgggggaccggccgggcctggcaccaatctgcgctgcggtcgggcggagcttctgtttctcccagccaatcatgtgactcaaggaaaacttccggcgctgtgtccagtctcctccaatcaatggccttcgggggcgggccagcggccgctcaatccccactccctcatgctttgggttagggttttctttcacgctttctgaggaggagagcatggcgcgggcctcggcgaagcacttccgtcagcctcgggcggaggatcgtcttagtagctggccagacctggaggagagcgggcggtctttgcgggcctcaggagataggtggccgcccggcccctttccccgcctgcccggataggtgcgtgcagacccaccaaagaaaagcggtcgctgcgggacccccagtcccacctcggccgcgctgtgggatggctgcgcccccagggcttcctgcgtctccaggaagccgggagtggcgccctctgcggggtggggtgctcccgggccgaactccggacaggtggaggggacagggcagagctcgaggaagccctgtccccttcagtgcaaggtgctgtcactcacgtgtgccctcgaccctcccgttcacccgcagccttctcagcgcctctccctgggccggaggcctcctcaccagcctacctgttgctctggaaaaaaatcccgtcccccgactccgtccctacccccagtcttcggccggctctggcccctggggagggggctgcacggcggaaggaggctggctatgggcccggctgcccgctgcatgtacctcctcctccacccatcgcctcttgcctgggggtaactttgcctggggctcattctttggttaagctgaagctgccgtgggtggccaaaccgcagattctttgcaaattctgagctggcagagctcgcagccgggagccggccggggaagaggagacttgcgcgccgcaagccgcctgcctccaccctgctctccatctcccgctctagaagggctgggaagctcgcggccggggttccacctggaagctgcttgcatggctgaacccagcttaggtccctgacggggctgctggtggaattctcccccttcgaagctggggaggtttaggagggggaaggcttctgtgaagctctcaaaccactaatagagccccctccccaacagtgacggcgcagatgctcccccttttcttagttgacaccaccaggcagcttcctggccgttggtaggttcctgcagctggctgagggaacagggaccggcaggggactttgttaggggagggttgggatgggcagtgggcccctgaaagttaatatattggaacctagctcgagtgtcgttctttccaattccgaaagtagaaagagtaaaaataggggtgattggggtggggttagtagaatgcctctctcagggcgctcccccctcccccaccgttttagagagctaggcctcagccagtcttgccactcccatctcagtgcttcctgaagaggctgttttgagtgttgatgaaaagcaatgcaattatgccaaacagtattgagcagaataatttatttcttttttttcttttgctttaaatcatgaatcccgccaggtacggtggctcacacctgtcatcccagcactttgggaggccaaggcgggcggattacttaatacttaaggtcaggagttcgagaccagcctggccaatatggtgaaacctcgtctctaccaaaaaaaaaaaaaaatacaaaaattagccaggcgcagtggtgcgcacctgtaatcccagctacttggaaggctgaggcaggagaatcccttgaaccgaggaggcgaaggttgcagtgagccgagattgtgccactgcactccagcctgggcgacagagcaagaccctgtctcaaaaaaattaaatcatgaatccccatcctggaagaggtaggtcccagcatccagccagattttctgcaatagtaatttaaacacacttttttatttccttccctttctgaattaaaaggaacaaaaaactgtctagtccttcattgttctgaaatgggcatgatggaagaaggcgggtctggtaggatagctgtgactgataatg

SEQ ID NO: 573 - DNA, 1619 bp, Homo sapiens
accaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgc

SEQ ID NO: 574 - DNA, 411 bp, Homo sapiens
atggtaaggccttaccccctgatctacttcctcttcctgccgctgggcgcctgcttccctctactggacagaagagagcccacagacgccatgggtggcctcggagctggagaacgctgggccgacctggccatggggccccgaccccactccgtgtggggttcctctcggtggctgagagcttcacagccacaggccctgcttgtcatagccagggggctgcagacatcgggcagagagcatgctggctgcagattccgcttcgggaggcaggacgaaggcagtgaggccaccggcttcctccctgctgcgggggagaagaccagcggcccgttagggaacctggctgaggagctcaatggctacagcaggaagaaaggcggcttcagcttccgcttcggtcggcggtga

SEQ ID NO: 575 - DNA, 663 bp, Homo sapiens
atgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctag

SEQ ID NO: 576 - DNA, 2575 bp, Homo sapiens
ggcagagcagggaagccaacctgagcaaacacagcagcccgagtgttcccaaggccaaaatgctgagaacgtccactcctaatctgtgtggtggtctgcattgccgggccccctggctctcttctggcattctctgcctctgcctcatattcttgttgggccaggtgggcttgctgcagggacacccccagtgcctggattacgggccccctttccagccccctctgcaccttgagttttgctctgactatgagtccttcggctgctgtgatcagcacaaggaccgccgcatcgctgcccggtactgggacatcatggaatattttgatctgaagagacatgagctgtgtggagattacattaaagacatcctttgccaggagtgctcgccctacgcagcccacctctacgacgccgaaaacacccagacgcctctccggaatctcccgggcctctgctctgattactgctctgccttccattctaactgtcactcagccatttccctgctgaccaatgaccgcggcctccaggagtctcatggaagggacggtacccgcttctgccacctcctggaccttcctgacaaggactattgcttccctaatgtcctgaggaacgactatctcaaccgccacctgggcatggtggcccaagatcctcagggctgcctgcagctctgcctgagcgaggtggccaacgggctgaggaaccccgtctccatggtccatgctggggacggcacccatcgcttctttgttgccgagcaggtaggagtggtgtgggtctacctccctgatgggagtcgcctggagcaacccttcctggacctcaagaacatcgtgttgaccaccccatggatcggggatgagagaggcttcttggggttggcttttcaccccaaattccgccacaatcgcaagttctatatttattattcgtgcctggacaagaagaaggtagaaaagatccgaattagtgagatgaaggtttctcgggctgatcctaacaaagctgacctgaaatcagagagggtcatcttggagattgaagaaccagcctcaaaccataatggcggacaacttctttttggcctggatggctatatgtacatattcactggggacgggggacaggctggagatccctttggcctgtttggaaatgctcagaacaaaagttccctgctgggaaaagttttaaggatcgatgtgaacagggcaggctcacatggcaagcggtaccgagtcccctcggacaatccatttgtttctgagccaggggcccaccccgccatctatgcctatgggatcaggaacatgtggcgttgtgctgtggaccgaggggaccccatcacgcgccagggccgaggccggatattctgtggggacgtgggccagaacaggtttgaagaggttgacctcattttgaaaggtggaaactatggctggagagcaaaggaagggtttgcatgttatgacaaaaaactttgtcacaatgcctctttggatgatgttctgccaatctatgcttatggccatgcagtggggaagtcagtcactggaggttatgtctatcgtggttgtgaatccccaaatctcaatggcctgtatatctttggagacttcatgagtggtcgacttatggctttgcaggaagatagaaaaaacaagaaatggaagaagcaggatctttgcctgggcagcaccacgtcctgtgccttcccagggctgatcagcacccatagcaagttcatcatctcctttgctgaagatgaagcaggggagctgtatttcctggcgacctcttacccaagtgcctatgcaccacgtggatctatttacaagtttgttgacccctcaaggcgagcacccccaggcaagtgcaaatacaagccagtgcccgtgagaaccaagagtaagcggatcccgttcagaccactcgccaagacagtcttggacttgctaaaggaacaatcagagaaagctgctagaaaatcttccagtgcaaccttagcttctggcccagcccagggtttgtctgagaaaggctcctccaagaagctggcttctcctacaagcagcaagaatacattgcgagggcctggtacaaagaagaaagccagagtggggccccacgtccgccagggcaagaggaggaagagcctgaaaagccacagtggcaggatgaggccatcagcagagcagaagcgagctggcagaagtctcccttgacctattggtcaaggtggccgacagggtgacgtgagagaggagagccacctcatcaaatgaaagtcactgctgaataaagaccttagaagtctgggaagccagggtagaggtggggcagggcggttttcctctccctgggaaatcttgctgtctactgaataaataaatgcaccttctctgtatgcagtgcttctgtgggagaccatatcccagattgctggtgcacctgggttatggtaagcactagtccatgagcctgcttggaatcacactggatgtctccgttttgtcttgtaaatgcctacaacctgaggtaataaatcaacatttgctcaaactgg

SEQ ID NO: 577 - DNA, 2052 bp, Homo sapiens
tgctgcgcaccgggcctcgcgccccgcgccccgcgccccgcgccccgcgccccgcaccggcctccaggatcatgtggtatgtcagcaccaggggcgtagccccacgggtcaactttgagggggccctcttctctggctatgcacctgacgggggcctctttatgcctgaagagctcccacagttggacagagggaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagtgggagagacaggactacgaaaaaatggctgtaatggagtgtgatgggtgctgtgtggaactgtgccttggaaactgtgggcccagaagagggagcgtgacagatatcccagggacagccatggtcagaggtggtggctgagctggcctccaaccaggaggagcagtttgccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggaccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 578 - DNA, 1720 bp, Homo sapiens
acacgcagctagacacagctaacttgagtcttggagctcctagagggaagcttctggaaaggaaggctcttcaggacctcttaggagccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaaggggcttgctcaccaccttctccctggagagggcagaagaggtcacacgcagagactgctactacatcttactcacctgccaaggcttggtggccaacacccagaggaacaaattaaggaccgggaattaattcccaggggctccctggtgcccaaaggacaagagcttcca

SEQ ID NO: 579 - DNA, 3031 bp, Homo sapiens
gactcagtttcaccagaaaccagggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttacggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacgcggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctatcctctcttcctcttcccccaagattgagctctctgcccttgatcagccccaccctggcctagaccagcagacagagccaggagaagctcagctgcattccgcagcccccacccccaaggttctccaacatcacagcccagcccgcccactgggtaataaaagtggtttgtggagtttctggctctgttctgtgggccaggagagggactaggttgctggggggtgatgggaccgtcctgttcagctggttcaggcttcagccaccctgttgagcaggttttcccatcgtctctctcgaaactggcctggcccctgactttggagagcagtgccatgtttgaccaccagaggggaggagtgagcgggccacgggagccacgagtgtggggaggctgcagtgctgctgtgtagcatttcttcctggtgtgagcctctccacaagcctgttgagtggttgagctctccacaattctgctcatttggaggttggggttaggggtgcacaggcaccttggctcctacctccatgttagggcccaggtgactagctgtctccctcccaacagaagccctggcttctgcgctggagtgcagcacccccaaccaggctctgagctccttcccaggagcctttagtagagacacgccactccaacccacacccctgcatttgttcaagctacctcccggtgccaaaaaaaaaaaaaaatcatactttgagctca

SEQ ID NO: 580 - DNA, 2144 bp, Homo sapiens
gcttttctgatagcaatttcatgagtcagctgacctaagatacatacttcaattctcatgggatttcttgagctaggaaaggtggttggcttacggcacagtagagagcttccagggctggctggcgtgggatacccgtaccacagaaatgcagggaccattgcttcttccaggcctctgctttctgctgagcctctttggagctgtgactcagaaaaccaaaacttcctgtgctaagtgccccccaaatgcttcctgtgtcaataacactcactgcacctgcaaccatggatatacttctggatctgggcagaaactattcacattccccttggagacatgtaacgacaccacctcctcaaagacaaccgagggcaggaaagagctgcaaaagattgtggacaaatttgagtcacttctcaccaatcagactttatggagaacagaagggagacaagaaatctcatccacagctaccactattctccgggatgtggaatcgaaagttctagaaactgccttgaaagatccagaacaaaaagtcctgaaaatccaaaacgatagtgtagctattgaaactcaagcgattacagacaattgctctgaagaaagaaagacattcaacttgaacgtccaaatgaactcaatggacatccgttgcagtgacatcatccagggagacacacaaggtcccagtgccattgcctttatctcatattcttctcttggaaacatcataaatgcaactttttttgaagagatggataagaaagatcaagtgtatctgaactctcaggttgtgagtgctgctattggacccaaaaggaacgtgtctctctccaagtctgtgacgctgactttccagcacgtgaagatgacccccagtaccaaaaaggtcttctgtgtctactggaagagcacagggcagggcagccagtggtccagggatggctgcttcctgatacacgtgaacaagagtcacaccatgtgtaattgcagtcacctgtccagcttcgctgtcctgatggccctgaccagccaggaggaggatcccgtgctgactgtcatcacctacgtggggctgagcgtctctctgctgtgcctcctcctggcggccctcacttttctcctgtgtaaagccatccggaacaccagcacctcactgcatctgcagctctcgctctgcctcttcctggcccacctcctcttcctcgtggggattgatcgaactgaacccaaggtgctgtgctccatcatcgccggtgctttgcactatctctacctggccgccttcacctggatgctgctggagggtgtgcacctcttcctcactgcacggaacctgacagtggtcaactactcaagcatcaatagactcatgaagtggatcatgttcccagtcggctatggcgttcccgctgtgactgtggccatttctgcagcctcctggcctcacctttatggaactgctgatcgatgctggctccacctggaccagggattcatgtggagtttccttggcccagtctgtgccattttctctgcgaatttagtattgtttatcttggtcttttggattttgaaaagaaaactttcctccctcaatagtgaagtgtcaaccatccagaacacaaggatgctggctttcaaagcaacagctcagctcttcatcctgggctgcacatggtgtctgggcttgctacaggtgggtccagctgcccaggtcatggcctacctcttcaccatcatcaacagcctccaaggcttcttcatcttcttggtctactgcctcctcagccagcaggtccagaaacaatatcaaaagtggtttagagagatcgtaaaatcaaaatctgagtctgagacatacacactttccagcaagatgggtcctgactcaaaacccagtgagggggatgtttttccaggacaagtgaagagaaaatattaaaactagaatattcaactccatatggaaaatcatatccatggatctctttggcattatgaagaatgaagctaaggaaaagggaattcattaaacatatcatccttggagaggaagtaatcaacctttacttcccaagctgtttgttctccacaataggctctcaacaaatgtgtggtaaattgcatttctcttc

SEQ ID NO: 581 - DNA, 3127 bp, Homo sapiens
ctgttaaggtatacagacagtagttaaatagcagggccaactattctgttaagggtcttcctagacagactaaaaaagccatgtattctttcgtttctctctaaaagaagaaaaatataatttaaaaatacattgcgtattttctaaaacaataaatttatagtgttaatattcatagggtcaatcaaaatgaagcttctcctttgggcctgcattgtatgtgttgcttttgcaaggaagagacggttccccttcattggtgaggatgacaatgacgatggtcacccacttcatccatctctgaatattccttatggcatacggaatttaccacctcctctttattatcgcccagtgaatacagtccccagttaccctgggaatacttacactgacacagggttaccttcgtatccctggattctaacttctcctggattcccctatgtctatcacatccgtggttttcccttagctactcagttgaatgttcctcctctccctcctaggggtttcccgtttgtccctccttcaaggtttttttcagcagctgcagcacccgctgccccacctattgcagctgagcctgctgcagctgcacctcttacagccacacctgtagcagctgagcctgctgcaggggcccctgttgcagctgagcctgctgcagaggcacctgttggagctgagcctgctgcagaggcacctgttgcagctgagcctgctgcagaggcacctgttggagtggagccagctgcagaggaaccttcaccagctgagcctgctacagccaagcctgctgccccagaacctcacccttctccctctcttgaacaggcaaatcagtgaaattctctagaagagtaccatgggttcatttctatactgatgcagaaataagtgaaatctacaaaagttttctttcttttccaaagactatttcattctgttgtattcagagtattcatctcactacattgatttgtttgtggtagtttttccttggacttaatttatattgaaaaaacattgataattaaataaataaaatagataatttagaccaatggtgataaggtctggatgaaaactacgctatggaggactgaaatggcaatcattcagcctagcctggagtctgattatacagctactataggatgatgttagtattggttttgagtgcaataggttttttcctaaacaaacatattttgtagtcaatgaactttttgtcacaaaacagtaaaacatctgtgtttaacctatggtaaacaacatgttaatgaactatgctatccatgacttaatggacagttcaaatgtgacatctacagtttttcatttctcttttatgccagcacacaatcaattcatcaccaattgtcatttgatttacttcaaaaaatatacccccaaatcctaatacttctaaccttctccactgcatctagccaactctagctattgtcatccctaacagaaatggaggaatagcctctttttttttttttttttttgagacgaagtctcacactgttgcacggctgtagtgcaatggtgccaactcagctcactgcaacttccacctcccgggttcaagtgattctcctgcctcagcctcctgagtagccgggattacaggtgtgtgccaccacgcctggctaattttttgtaatttagtacagacaggggttccctatgttggccaggatggtcttgatctcctgacctcatgatctgtccgcctcggcctcccaaagtgctgggaatacaggcgtgagccaccgtgccctgccagaatagcctattaaccagtctacctgcttccacttttcctccaccctgatcacatacacacatgcattatccactgagcagtcacaatcagatgttaaaccaaacattattcagataagatctctgaaaagcctctgatactttctcttttaaaatggaatatattctaaacacctctccaaggacacaagacttaccttgtctaactaatgacttttctaacttcattccctatcattctccatcttgccccatgctcctcatgcagcagcttttttttttttttcctttttcaaatatgttggttttgatcttatccaagaacctttgccctgatgtatgaatgactaactgcttttctacttcgggggtctcatatagaaatcctgcttcagaatactcttccctgagcactctatctaaataaatccctcttctgcaacccagtgctttttgttctattactgacttcttttccttgtagaagttactattactgctttttacctttttatttatttgtgtattgtctttgttgttgccctcatcttatctccacaaaaatatatgctccataaaaacaggcatttctgtgtcttattcagcactttatcagggcctataacaatgcctgggacatattcagtgaccagtgaatatttttggaaggaaagaaaagaagaaagaatgaagtaacaaacaaagaatgaaggaagaaaaaatttttacaaacattcaacatatttttattttgaaataattttgtatttttccctatatcctacattggatcagaatattactgttatgtatagccatgaggacatggtctcaaaaaatgagaaactttcttagacagtaaaattgttaacttgagatgtttgcttccatcttctagagccaagtaggatctaactttaatttgacttagccaataatctgaaactattatagtatctgtctttcacagatacatgcaatattcacttctaaatatttaatgataaatttgtaatcatacatgatagtcaattttaatgattatgttgtcaaaattcaggctttttgtgtgaattgaagacttaaagaagaatttgtaaatatgactgtataagaaacaacagaaagatgaagatgaaccgaaatagaaatatcaagaggctacaaagtcttagcaaattataattgctaatggtacattatgtggtgtttagtatcacatttagaatgtagtcatttgttaagtttttcatggggtaaaagaaagaatttattccaagaaaattttggaattttaaaaataaacatgacatcttatcatgagaaa

SEQ ID NO: 582 - DNA, 2544 bp, Homo sapiens
caggctccgcgccgggctcgcccgccgggcaggcgcacggcggacacctgcgagcctggaggtggcggtcgctgcgaacccggcggcgcggccaaacctgtgctggctgcctgggccttctgggcctcctgggccagaagctggcgctgggggcggcggcggggtgggaaagcggcgccgccgtggggcctcctggacgcgtcggcggaggtggcttcgtcccgcggagtccaggcttcaggctttcaccagttctcaggatgcccatagggatgggtgaagcctgcctggcctgtggtgcttcccagtggccgtcatctcattagggccccacagtggcattaggatgcacctctcggcggtgttcaacgccctcctggtgtcggtgctggcagcggtcctgtggaagcatgtgcggctgcgtgagcatgcagccacactggaggaggagctggccctcagccgacaggccacagagccagccccagcactgaggatcgactacccgaaggcactgcagatcctgatggagggcggcacacacatggtgtgcacgggccgcacgcacacagaccgcatctgccgcttcaagtggctctgctactccaacgaggctgaggagttcatcttcttccatggcaacacctctgtcatgctgcccaacctgggctcccggcgcttccagccagccctgctcgacctatccaccgtggaggaccacaacactcagtacttcaacttcgtggagctgcctgctgctgccctgcgcttcatgcccaagccggtgttcgtgccagacgtggccctcatcgccaaccgcttcaaccccgacaacctcatgcacgtctttcatgacgacctgctgccactcttctacaccctgcggcagtttcccggcctggcccacgaggcacggctcttcttcatggagggctggggcgagggtgcacacttcgacctctacaagctgctcagccccaagcagcctctcctgcgggcacagctgaagaccctgggccggctgctgtgcttctcccatgcttttgtgggcctctccaagatcactacctggtaccagtatggctttgtgcagccccagggcccgaaggccaacatcctcgtctcaggcaatgagatccggcagtttgcacggttcatgacagaaaagctgaacgtgagccacacaggagtccccctaggcgaggagtacattctggtctttagccgaacccagaacagactcattctgaatgaggcagagctgctgctggcactggcccaggagttccagatgaagacagtgacagtgtccctggaggaccacacctttgctgatgtcgtgcggctggtcagcaatgcctccatgctggtcagcatgcatggggcccagctggtcaccaccctcttcctgccccgtggggcaactgtggtagagctcttcccatatgctgtcaatcccgaccactacactccctataagacgctggccatgctgcctggcatggacctccagtatgtagcctggcggaacatgatgccagagaacacagtcacacaccctgagcggccctgggatcaggggggcatcacccatctggaccgggctgagcaagcccgtatcctgcaaagccgtgaggtcccacggcatctctgttgccggaaccccgagtggctcttccgaatctaccaggacaccaaggtggacatcccgtccctcattcaaaccatacggcgcgtggtgaagggccggccaggaccacggaagcagaagtggacagtcggcctatatccaggcaaggtgcgggaggcacggtgccaggcgtcagtgcatggcgcctccgaggcccgcctcactgtctcctggcagatcccatggaaccttaaatacctgaaggtgagggaggtgaagtacgaggtgtggctgcaggagcagggggagaacacctacgtgccttacatcctggctctgcagaaccacaccttcactgagaacatcaagcccttcaccacctacctggtgtgggtccgctgcatcttcaacaagatcctcctgggaccctttgcagatgtgctggtgtgcaacacgtagcgagcaggccacagcctggcctcgggaaggtggctcctgcagttcagcgtccctgggcccattaatcccactgtggagacttctgggaactatttattgagcaggcctgtgcctccacatcatcttgttgtctctggggtgtggtgtcacagcactcctctttgccctagagataagggacctgacttccccttctcccatcctgaacatttgtacccctggagaagttccttagcagggaggaggaagaggagaggaggaagcaaagaatcacaaggaacctctggctaggtgatcctgatgtttcctactgagtttttctggtatccagatttctggaaaccgagtaatcatgtactgtttgattgggtggttcatctgcttccatcccagtgaaatttacctgtagcccagtgaagggtgtgtttggaacattcattaaatgattctaagca

SEQ ID NO: 583 - DNA, 6720 bp, Homo sapiens
atgggcttcttgcccaagcttctcctcctggcctcattcttcccagcaggccaggcctcatggggcgtctccagtccccaggacgtgcagggtgtgaaggggtcttgcctgcttatcccctgcatcttcagcttccctgccgacgtggaggtgcccgacggcatcacggccatctggtactacgactactcgggccagcggcaggtggtgagccactcggcggaccccaagctggtggaggcccgcttccgcggccgcaccgagttcatggggaaccccgagcacagggtgtgcaacctgctgctgaaggacctgcagcccgaggactctggttcctacaacttccgcttcgagatcagtgaggtcaaccgctggtcagatgtgaaaggcaccttggtcacagtaacagaggagcccagggtgcccaccattgcctccccggtggagcttctcgagggcacagaggtggacttcaactgctccactccctacgtatgcctgcaggagcaggtcagactgcagtggcaaggccaggaccctgctcgctctgtcaccttcaacagccagaagtttgagcccaccggcgtcggccacctggagaccctccacatggccatgtcctggcaggaccacggccggatcctgcgctgccagctctccgtggccaatcacagggctcagagcgagattcacctccaagtgaagtatgcccccaagggtgtgaagatcctcctcagcccctcggggaggaacatccttccaggtgagctggtcacactcacctgccaggtgaacagcagctaccctgcagtcagttccattaagtggctcaaggatggggtacgcctccaaaccaagactggtgtgctgcacctgccccaggcagcctggagcgatgctggcgtctacacctgccaagctgagaacggcgtgggctctttggtctcaccccccatcagcctccacatcttcatggctgaggtccaggtgagcccagcaggtcccatcctggagaaccagacagtgacactagtctgcaacacacccaatgaggcacccagtgatctccgctacagctggtacaagaaccatgtcctgctggaggatgcccactcccataccctccggctgcacttggccactagggctgatactggcttctacttctgtgaggtgcagaacgtccatggcagcgagcgctcgggccctgtcagcgtggtagtcaaccacccgcctctcactccagtcctgacagccttcctggagacccaggcgggacttgtgggcatccttcactgctctgtggtcagtgagcccctggccacactggtgctgtcacatgggggtcatatcctggcctccacctccggggacagtgatcacagcccacgcttcagtggtacctctggtcccaactccctgcgcctggagatccgagacctggaggaaactgacagtggggagtacaagtgctcagccaccaactcccttggaaatgcaacctccaccctggacttccatgccaatgccgcccgtctcctcatcagcccggcagccgaggtggtggaaggacaggcagtgacactgagctgcagaagcggcctaagccccacacctgatgcccgcttctcctggtacctgaatggagccctgcttcacgagggtcccggcagcagcctcctgctccccgcggcctccagcactgacgccggctcataccactgccgggcccgggacggccacagtgccagtggcccctcttcgccagctgttctcactgtgctctacccccctcgacaaccaacattcaccaccaggctggaccttgatgccgctggggccggggctggacggcgaggcctccttttgtgccgtgtggacagcgacccccccgccaggctgcagctgctccacaaggaccgtgttgtggccacttccctgccatcagggggtggctgcagcacctgtgggggctgttccccacgcatgaaggtcaccaaagcccccaacttgctgcgtgtggagattcacaaccctttgctggaagaggagggcttgtacctctgtgaggccagcaatgccctgggcaacgcctccacctcagccaccttcaatggccaggccactgtcctggccattgcaccatcacacacacttcaggagggcacagaagccaacttgacttgcaacgtgagccgggaagctgctggcagccctgctaacttctcctggttccgaaatggggtgctgtgggcccagggtcccctggagaccgtgacactgctgcccgtggccagaactgatgctgccctttacgcctgccgcatcctgactgaggctggtgcccagctctccactcccgtgctcctgagtgtactctatcccccggaccgtccaaagctgtcagccctcctagacatgggccagggccacatggctctgttcatctgcactgtggacagccgccccctggccttgctggccttgttccatggggagcacctcctggccaccagcctgggtccccaggtcccatcccatggtcggttccaggctaaagctgaggccaactccctgaagttagaggtccgagaactgggccttggggactctggcagctaccgctgtgaggccacaaatgttcttggatcatccaacacctcactcttcttccaggtccgaggagcctgggtccaggtgtcaccatcacctgagctccaagagggccaggctgtggtcctgagctgccaggtacacacaggagtcccagaggggacctcatatcgttggtatcgggatggccagcccctccaggagtcgacctcggccacgctccgctttgcagccataactttgacacaagctggggcctatcattgccaagcccaggccccaggctcagccaccacgagcctagctgcacccatcagcctccacgtgtcctatgccccacgccacgtcacactcactaccctgatggacacaggccctggacgactgggcctcctcctgtgccgtgtggacagtgaccctccggcccagctgcggctgctccacggggatcgccttgtggcctccaccctacaaggtgtggggggacccgaaggcagctctcccaggctgcatgtggctgtggcccccaacacactgcgtctggagatccacggggctatgctggaggatgagggtgtctatatctgtgaggcctccaacaccctgggccaggcctcggcctcagctgacttcgacgctcaagctgtgaatgtgcaggtgtggcccggggctaccgtgcgggaggggcagctggtgaacctgacctgccttgtgtggaccactcacccggcccagctcacctacacatggtaccaggatgggcagcagcgcctggatgcccactccatccccctgcccaacgtcacagtcagggatgccacctcctaccgctgcggtgtgggcccccctggtcgggcaccccgcctctccagacctatcaccttggacgtcctctacgcgccccgcaacctgcgcctgacctacctcctggagagccatggcgggcagctggccctggtactgtgcactgtggacagccgcccgcccgcccagctggccctcagccacgccggtcgcctcttggcctcctcgacagcagcctctgtccccaacaccctgcgcctggagctgcgagggccacagcccagggatgagggtttctacagctgctctgcccgcagccctctgggccaggccaacacgtccctggagctgcggctggagggtgtgcgggtgatcctggctccggaggctgccgtgcctgaaggtgcccccatcacagtgacctgtgcggaccctgctgcccacgcacccacactctatacttggtaccacaacggtcgttggctgcaggagggtccagctgcctcactctcattcctggtggccacgcgggctcatgcaggcgcctactcttgccaggcccaggatgcccagggcacccgcagctcccgtcctgctgccctgcaagtcctctatgcccctcaggacgctgtcctgtcctccttccgggactccagggccagatccatggctgtgatacagtgcactgtggacagtgagccacctgctgagctggccctatctcatgatggcaaggtgctggccacgagcagcggggtccacagcttggcatcagggacaggccatgtccaggtggcccgaaacgccctacggctgcaggtgcaagatgtgcctgcaggtgatgacacctatgtttgcacagcccaaaacttgctgggctcaatcagcaccatcgggcggttgcaggtagaaggtgcacgcgtggtggcagagcctggcctggacgtgcctgagggcgctgccctgaacctcagctgccgcctcctgggtggccctgggcctgtgggcaactccacctttgcatggttctggaatgaccggcggctgcacgcggagcctgtgcccactctcgccttcacccacgtggctcgtgctcaagctgggatgtaccactgcctggctgagctccccactggggctgctgcctctgctccagtcatgctccgtgtgctctaccctcccaagacgcccaccatgatggtcttcgtggagcctgagggtggcctccggggcatcctggattgccgagtggacagcgagccgctcgccagcctgactctccaccttggcagtcgactggtggcctccagtcagccccagggtgctcctgcagagccacacatccatgtcctggcttcccccaatgccctgagggtggacatcgaggcgctgaggcccagcgaccaaggggaatacatctgttctgcctcaaatgtcctgggctctgcctctacctccacctactttggggtcagagccctgcaccgcctgcatcagttccagcagctgctctgggtcctgggactgctggtgggcctcctgctcctgctgttgggcctgggggcctgctacacctggagaaggaggcgtgtttgtaagcagagcatgggcgagaattcggtggagatggcttttcagaaagagaccacgcagctcattgatcctgatgcagccacatgtgagacctcaacctgtgccccacccctgggctgaccagtggtgttgcctgccctccggaggagaaagtggccagaatctgtgatgactccagcctatgaatgtgaatgaggcagtgttgagtcctgcccgcctctacgaaaacagctctgtgacatctgactttttatgacctggccccaagcctcttgcccccccaaaaatgggtggtgagaggtctgcccaggagggtgttgaccctggaggacactgaagagcactgagctgatctcgctctctcttctctggatctcctcccttctctccatttctccctcaaaggaagccctgccctttcacatccttctcctcgaaagtcaccctggactttggttggattgcagcatcctgcatcctcagaggctcaccaaggcattctgtattcaacagagtatcagtcagcctgctctaacaagagaccaaatacagtgacttcaacatgatagaattttatttttctctcccacgctagtctggctgttacgatggtttatgatgttggggctcaggatccttctatcttccttttctctatccctaaaatgatgcctttgattgtgaggctcaccatggccccgctttgtccacatgccctccagccagaagaaggaagagtggaggtagaagcacacccatgcccatggtggacgcaactcagaagctgcacaggacttttccactcacttcccattggctggagtattgtcacatggctactgcaagctacaagggagactgggaaatgtagtttttattttgagtccagaggacatttggaattggacttccaaaggactcccaactgtgagctcatccctgagacttttgacattgttgggaatgccaccagcaggccatgttttgtctcagtgcccatctactgagggccagggtgtgcccctggccattctggttgtgggcttcctggaagaggtgatcactctcacactaagactgaggaaataaaaaaggtttggtgttttcctagggagagagcatgccaggcagtggagttgcctaagcagacatccttgtgccagatttggcccctgaaagaagagatgccctcattcccaccaccaccccccctacccccagggactgggtactaccttactggcccttacaagagtggagggcagacacagatgttgtcagcatccttattcctgctccagatgcatctctgttcatgactgtgtgagctcctgtccttttcctggagaccctgtgtcgggctgttaaagagaatgagttaccaagaaggaatgacgtgcccctgcgaatcagggaccaacaggagagagctcttgagtgggctagtgactccccctgcagcctggtggagatggtgtgaggagcgaagagccctctgctctaggatttgggttgaaaaacagagagagaagtggggagttgccacaggagctaacacgctgggaggcagttgggggcgggtgaactttgtgtagccgaggccgcaccctccctcattccaggctcattcattttcatgctccattgccagactcttgctgggagcccgtccagaatgtcctcccaataaaactccatcctatgacgcaa

SEQ ID NO: 584 - DNA, 1953 bp, Homo sapiens
gctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggcggcggcggcggcggcggaggaggcgaccgagaagatacccgccctgcgccccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagcaacatggccaatctttcctaagctgctcagcttacaagaaaaggaatcatactgctaagaattcaaacttcagcagtcatagggagccttgggaggaccccgaatcactgatggaattgcgcagtgcatggagatggctcagcaggatgagggtaaatgcaggggcaagtccaggccatactgagagacaatgagtggcgctgatgaggacaaagataaaatcaaaagtttgtgcttcatcttcaaaaactcaagctgataacaaacttggcctgatgagaaataataagtatttttctatttacatgagaatttaatctcaaaacagaaatcagaaaaatatgaagtccagggcataaaacctaaaactattgctcatatttattctttctaaatagagcaaagtgtaaaatcttctccataagacatacattgtggttataaaaaggcaaaagtcttagtgagaatcattggtattccatagaagagtgaattaaacacagccaagggaagacccacgtctcatacttctcttgtatattccaaagttccagggaaattccaggtgatagaggttatttcccatactgttaaagcaaggtttcagacacttctgaattttggtcccagtactctagaagggcacacctctgtcctggaaaataatacaggaatgaatactcttcccgtgacccattctggtcattcttccagcatcacaaaaaccaaaaaatggaaatatggccaaatacgtgattagctgtccctcatcttcaggtttcttatctgttacttatagataatagcattaccttaaggattatgatgaagatacaatgtccaaatataaacacagttttgagcaaaatgccttgtacgaattggtcaatgaataattactaaatatgtgaatatttctggattgtatggatcctatgaataattactgaataatt

SEQ ID NO: 585 - DNA, 834 bp, Homo sapiens
agaacagaggctgagctcgaagcgccgggcagtacagtgagggagagccgagggaaccagcgcggtgcctagcggaactccagggctggaatcccgagacacaagtgcatctgctagctgttagcacttggcagacggagttctcctctagggtagttctaactttgggtaataatgtttgtcagctacctgatattaacattgctccacgttcaaacagcagtgttagcaagacctgggggagagagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaaaaaaaaaagccatttaaagccagccactagagggagtcagttcagttccgtaaaggtatgctcagtgcccgctgcctgcaagctgttggggaccccagggagggcaaggcagcctgtccccgcccccagggaactagaacatgacaagaattctccgcactgtgcctacctgtccctttaccttacctctctggcccagagttcttggagggttttttctttattttcttatgtactcatctacttattctcaaagtatttagcattcaacactctttttgctttaaaaagaatggccttacaaagggacagaaaagagaagacacgagcttggtgtattttcatcaagttatgtggcagagaaatccagatattaccaggacctgtctaa

SEQ ID NO: 586 - DNA, 571 bp, Homo sapiens
gcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccacata

SEQ ID NO: 587 - DNA, 1080 bp, Homo sapiens
tggcatggacctgcatcttccctgaagcatctccagggctgaaaaatcactgaccatggcaccatggtctcatccatctgcacagctgcagccagtgggaggagacgccgtgagccctgccctcatggttctgctctgcctcgggaacctctccaaagccaccctctgggctgagccaggctctgtgatcagccgggggaactctgtgaccatccggtgtcaggggaccctggaggcccaggaataccgtctggttaaagagggaagcccagaaccctgggacacacagaacccactggagcccaagaacaaggccagattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcatatcctgcaggtatggtcagaacccagtgacctcctggagattccggtctcaggagcagctgataacctcagtccgtcacaaaacaagtctgactctgggactgcctcacaccttcaggattacgcagtagagaatctcatccgcatgggcatggccggcttgatcctggtggtccttgggattctgatatttcaggattggcacagccagagaagcccccaagctgcagctggaaggtgaacagaagagagaacaatgcaccattgaatgctggagccttggaagcgaatctgatggtcctaggaggttcgggaagaccatctgaggcctatgccatctggactgtctgctggcaatttctttttttctttcttttcttttctttcttttttttttttttt

SEQ ID NO: 588 - DNA, 736 bp, Homo sapiens
agggggatcctgcaagcagaaatctgtggtgggcgggcggcaggtgagcaaggagaacgtgtctgtaaaggaagcacagggaacaggtggtggctttgtaagacagttggaacccaaggaaggcaggccatcccccaggaaagcctatgttggtgagggttatgatgggagaatgagtgaactgcagcctggcaccaccacaccctggaaggtgcagttgggaagaaagtttctgaggctgtagacatggggatcggatgctggagaaaccccctgctgctgctgattgccctggtcctgtcagccaagctgggtcacttccaaaggtgggagggcttccagcagaagctcatgagcaagaagaacatgaattcaacactcaacttcttcattcaatcctacaacaatgccagcaacgacacctacttatatcgagtccagaggctaattcgaagtcagatgcagctgacgacgggagtggagtatatagtcactgtgaagattggctggaccaaatgcaagaggaatgacacgagcaattcttcctgccccctgcaaagcaagaagctgagaaagagtttaatttgcgagtctttgatatacaccatgccctggataaactatttccagctctggaacaattcctgtctggaggccgagcatgtgggcagaaacctcagatgagggctcatatgattgagttgtgcactggctgttattaaactgtaaaggatca

SEQ ID NO: 589 - DNA, 1879 bp, Homo sapiens
atgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcac

SEQ ID NO: 590 - DNA, 2089 bp, Homo sapiens
tggagcttagacgccgagctcgccgccaaaccatgaaccgatgcccccgcaggtgccggagcccgctggggcaggcagcgcgatccctctaccagctggtgactgggtcgctgtccccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgca

SEQ ID NO: 591 - DNA, 2036 bp, Homo sapiens
agaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 592 - DNA, 3186 bp, Homo sapiens
actagagtagaagtgattgaatgtgaagtgtcaggagattgctcgctcgtccttcgttaaacccctggtccggctgtgtgctgtggatgcgggtgtgtgttgaggggacctgcgtctgccggggccgcaccccctcccgcaggaccttggctggccgcgcgtttcctgcctgtttcctgtccagcagctggcgagctggggaccggcaggaaaggatgcgctgcccagaaggggcgggaaccgaccacgcccggtcccgtgtgccccccgccctcccggcgcccgccctccccacgccgtcgggggcgggccccgcggggctgtgggagccgaacgccgcggggtcagggcgtgcagtctgggacgcgggatgcttggcgctctacctcgccgcccctgagccttcccgtccgcctcgccacgcgcccggacggcctggggttgctgcccgtcagtctcgaaaggtgtttttggggaaaaaaatcacaatctggacgtgagaaaggacatgaggagactaaagacctgggattttgtcaatcagaatgaaaccaatgttgaaagacttttcaaatctattgttggtggtactctgtgactatgttcttggagaagctgaatatcttctcttgagagagccaggccatgtagcactaagcaacgacacagtgtatgtggatttccagtattttgatggtgctaatgggacactgaggaatgtatctgtcctgctgttggaggccaacaccaatcagactgtaactaccaagtacctcctgaccaaccagtcccagggaacactaaagtttgagtgcttctatttcaaggaggctggtgactactggttcacaatgactccagaagcaacagacaacagcactccattcccctggtgggagaaaagtgcctttctgaaggtggaatggcctgtctttcacgttgacttgaataggagtgccaaggcagcagaaggcaccttccaagtgggcctatttaccagtcaaccactgtgcccgtttcctgtggacaagcccaacatcgtagtggatgtcatcttcaccaacagtcttcctgaggcaagaagaaattcaagacagccgctggaaataagaaccagcaaaaggacagaacttgctcaaggtcagtgggttgagtttggctgtgcacccttggggccagaagcctatgtcaccgtggtgctgaagctgcttgggcgagactcagtcattacctccacaggacccattgacctggcccagaaatttggatacaaactggtgatggtgccagaactcacatgtgagtccggggtagaggtgacagtgctgcctccaccatgcaccttcgtccaaggagtggtcactgtcttcaaggaggcccccagataccctgggaagaggaccattcacttggctgaaaacagcctgcccctgggagagaggaggacaatttttaactgtactttgtttgacatggggaagaataagtactgctttgactttggcatttcaagcagaagccatttttctgcaaaggaggagtgcatgctaattcagagaaatacagctttccagccatccagcccatctcctcttcagccccagggtccagtgaagtccaacaacatcgtgactgtcactggtatatccttgtgcttgttcatcatcattgccactgtgctcatcacgctgtggaggaggttcggccggccagccaagtgcagcacacctgctcgacacaactccatccactcccccagcttccggaagaactcggacgaggagaatatctgcgagctgagcgagcagcgcgggagcttctcggatgggggagacgggcccacggggagtccaggggacacaggcatccctctgacctacaggcggagcgggccggtacctcccgaggatgatgcctctggcagcgagagcttccagtccaacgcccagaagataatcccacctctgttcagctaccgccttgcccagcagcagttaaaggagatgaaaaagaaaggtctgacggaaactaccaaagtgtatcacgtgtctcagagtcccctgacagacactgccattgatgcggcccccagcgctcccttagatttggaaagcccggaagaagctgcagcaaacaagttccggatcaaatccccatttccggagcagcccgcggtcagtgccggggaaaggcctccctccaggctggatctaaatgtgactcaggccagttgtgccataagccccagccagactctgatccgcaagtcacaggcaaggcacgtgggcagcagagggggcccgtccgaaaggagccatgccaggaacgcccatttcaggaggacagcgagtttccatgaagccaggcaggcccggccgttccgagagaggagcatgtccactctgactccacggcaggcccctgcctacagctctaggacgcggacctgcgagcaggcagaggacagatttaggcctcagagtcgaggtgcccacctgtttcctgaaaaactggagcatttccaagaggcaagtggaacccgtggtccattaaaccctctccctaaatcctacactttggggcagcccttgaggaaaccagaccttggggatcaccaggcaggattagtggccggaattgagagaacagagccccacagagctcgtcggggaccgtcccccagtcacaagagtgtctcaaggaagcagtcttctcccatatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagctttacacagctggggtctgctactcgcgttttgtagacttttgtgtaactatttgtaccgtaggacagaatgtgaggaggaagtaacacacagaggaggatgtgtgtgtatgcatgtgtttgaattcacaaggaagaaattatttatcttgagctttttcctttgttattcaatttctattgatttattagtaataacaatgataataaaatgtaaatgagc

SEQ ID NO: 593 - DNA, 1804 bp, Homo sapiens
gcgccggctccgcgcctcgcgcccagtccgcgggccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggcccgggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccgtcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccctaccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctctcggtgatattttttctacgccaaaacagacgggaaagggaacaaaataaagtgaaatccaataca

SEQ ID NO: 594 - DNA, 888 bp, Homo sapiens
ggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaaggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcc

SEQ ID NO: 595 - DNA, 1362 bp, Homo sapiens
atgctgcggatcctgtgcctggcactctgcagcctgctgactggcacgcgagctgaccctggggcactgctgcggttgggcatggacatcatgaaccaggtccagagcgccatggatgagagtcatatcctggagaagatggcagccgaggcaggcaagaaacagccagggatgaaacctatcaagggcatcaccaatttgaaggtgaaggatgtccagctgcccgtcatcacactgaactttgtacctggagtgggcatcttccaatgtgtgtccacaggcatgaccgtcactggcaagagcttcatgggagggaacatggagatcatcgtggccctgaacatcacagccaccaaccggcttctgcgggatgaggagacaggcctccccgtgttcaagagtgagggctgtgaggtcatcctggtcaatgtgaagactaacctgcctagcaacatgctccccaagatggtcaacaagttcctggacagcaccctgcacaaagtcctccctgggctgatgtgtcccgccatcgatgcagtcctggtgtatgtgaacaggaagtggaccaacctcagtgaccccatgcctgtgggccagatgggcaccgtcaaatatgttctgatgtccgcaccagccaccacagccagctacatccaactggacttcagtcctgtggtgcagcagcaaaagggcaaaaccatcaagcttgctgatgccggggaggccctcacgttccctgagggttatgccaaaggctcgtcgcagctgctgctcccagccaccttcctctctgcagagcttgcccttctgcagaagtcctttcatgtgaatatccaggatacaatgattggtgagctgcccccacaaaccaccaagaccctggctcgcttcattcctgaagtggctgtagcttatcccaagtcaaagcccttgacgacccagatcaagataaagaagcctcccaaggtcactatgaagacaggcaagagcctgctgcacctccacagcaccctggagatgttcgcagctcggtggcggagcaaggctccaatgtccctctttctcctagaagtgcacttcaatctgaaggtccagtactcagtgcatgagaaccagctgcagatggccacttctttggacagattactgagcttgtcccggaagtcctcatcgattggcaacttcaatgagagggaattaactggcttcatcaccagctatctcgaagaagcctacatcccagttgtcaatgatgtgcttcaagtggggctcccactcccggactttctggccatgaattacaacctggctgagctggacatagtagagaatgccctgatgctggacttgaagctgggctga

SEQ ID NO: 596 - DNA, 1871 bp, Homo sapiens
ccgtcatccccctgcagccacccttcccagagtcctttgcccaggccaccccaggcttcttggcagccctgccgggccacttgtcttcatgtctgccagggggaggtgggaaggaggtgggaggagggcgtgcagaggcagtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgagggggtgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagattctcgctctgttgctcaggctggagtacagtggcgcaatctcggctcactgcaacctttgcctcctgggttcaagcaattctcttgcctcatcctcccgagtagctgggactacaggagcgtgccaccatacctggctaatttttatatttttttagtagagacagggtttcatcatgttgctcatgctggtctcgaactcctgatctcaagagatccgcccacctcaggctcccaaagtgtgggattataggtgtgagccaccgcgtctggctgaaaagcactttcaatgagactgtgttgaataaagggccaaggttcttgccacccagcactcatgggggctctctcccctagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcaaggccagggtaggtgggggccgggagggacccaggtgtgaacggatgaataaagttcaactgcaactg

SEQ ID NO: 597 - DNA, 1189 bp, Homo sapiens
agaaactctgtggggaagataagtcctgagcctagagctgccatttccacagacaactgaactaccttcaaacagatgtgtttttaggggcagcagatagaaggagctgaatccaggagtttccttccctgaaatgccccaacagaggcacagtcctccaccttccctggaacagagggctttcatctgtctctctgaagccatctccctcccctgtttatgcccagagctgctttccaatcccatggagtgcctccgtatctaaccatagccactgagtctaccaggtgttcctgagaagacaactaagccaaccgctccacactctgctgattttcttctacatctcacagggggaagagctggatcaccatgaaatatgtcttctatttgggtgtcctcgctgggacatttttctttgctgactcatctgttcagaaagaagaccctgctccctatttggtgtacctcaagtctcacttcaacccctgtgtgggcgtcctcatcaaacccagctgggtgctggccccagctcactgctatttaccaaatctgaaagtgatgctgggaaatttcaagagcagagtcagagacggtactgaacagacaattaaccccattcagatcgtccgctactggaactacagtcatagcgccccacaggatgacctcatgctcatcaagctggctaagcctgccatgctcaatcccaaagtccagccccttaccctcgccaccaccaatgtcaggccaggcactgtctgtctactctcaggtttggactggagccaagaaaacagtggccgacaccctgacttgcggcagaacctggaggcccccgtgatgtctgatcgagaatgccaaaaaacagaacaaggaaaaagccacaggaattccttatgtgtgaaatttgtgaaagtattcagccgaatttttggggaggtggccgttgctactgtcatctgcaaagacaagctccagggaatcgaggtggggcacttcatgggaggggacgtcggcatctacaccaatgtttacaaatatgtatcctggattgagaacactgctaaggacaagtgagaccctacttctccctctgcattccactggctctgccatggactatacaagcagataattttccctctattcaaaataaaatctccaaatgaaaatttgggaatgtagc

SEQ ID NO: 598 - DNA, 1639 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactgggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagct

SEQ ID NO: 599 - DNA, 3222 bp, Homo sapiens
agcagccagctccccagcaccgcacggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcggcaggcgcccaggccaccccccaggtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtgcccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaa

SEQ ID NO: 600 - DNA, 508 bp, Homo sapiens
gcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccacata

SEQ ID NO: 601 - DNA, 538 bp, Homo sapiens
gggaccggggccatgtctccacacctcactgctctcctgggcctagtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatgccgggctttatcgctgcctctattataagccccctggatggtctgagcacagtgacttcctggagctgctggtgaaagggactgtgccaggcactgaagcctccggatttgatgcaccatgaatgaggagaaatggcctcccgtcttgtgaacttcaatggggagaaataattagaatgagcaatagaaatgcacagatgcctatacatacatatacaaataaaaagatacgattcgcaa

SEQ ID NO: 602 - DNA, 564 bp, Homo sapiens
atgctgccttgcctcgccctgcttctcctgatggagctgtccgtgtgcactgtggcaggtgatggtggagaggaacagacactcagcactgaagcagagacctgggaaggcgctggccccagcattcagctccagctgcaggaggtgaagacgggcaaggcaagccagttctttgggctgatggggaagcgagtgggaggcagagaggatgaggcccaaggttcagagtaaaagcccccaccacagacttcccagaggacacggtgccgcttcttcctacctggatgtcacagctgacaagccggcaggccaactctcttctctgtgtctcctgtcctcatcgctggcacttcacacaaggcccacactgaacccactgggcttcttcctggactctcagtgtcaagcagcagtcctgcataaatgcacagcttcgccgtagcaagctgcactgactctgccctccctcacactcagagttggcatctcactgcacagcagtgaggagactcgcacactctgtatcctgtgcctagcacacagtaggcactcaataaatgagtg

SEQ ID NO: 603 - DNA, 684 bp, Homo sapiens
atgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaaccctggtgccctctccttccaggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctag

SEQ ID NO: 604 - DNA, 1485 bp, Homo sapiens
gcacttggctgtggtgtgtgctgcagggagcgggaggacatgggaggacgtgctccaggaggcctctccagcacctgccaaccggggaggagggaaccaagacagggagatgggagccgaggtctgaggacaagcagaagcttccccaccctccctcttagagctgcagagctggagaggcccctagagtccacccaacaacaacagtggcaatcatcatcaccatcatcatcatcatcaccatcatcatcatcatcatgatgtcagccacagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattct

SEQ ID NO: 605 - DNA, 651 bp, Homo sapiens
aggcccttccgcaatcggagccctcacagaggccaaactgatataaatctgcttaggaggcctgattcacagacgctacaggatggagcggggcgcaggagccaagctgctgccgctgctgctgcttctgcgggcgactggtttcacatgtgcacagacagatggccggaacggctacacggcggtcatcgaagtgaccagcgggggtccctggggcgactgggcctggcctgagatgtgtcccgatggattcttcgccagcgggttctcgctcaagctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagttg

SEQ ID NO: 606 - DNA, 1987 bp, Homo sapiens
tatccaaggtgcagcagctgagcattccaaattcgggaaccaccagaaaggctggcctctcttcaacatgggatcttctggacttttgagcctcctggtgctattcgtcctcttagcgaatgtccagggacctggtctgactgattggttatttcccaggagatgtcccaaaatcagagaagaatgtgaattccaagaaagggatgtgtgtacaaaggacagacaatgccaggacaacaagaagtgttgtgtcttcagctgcggaaaaaaatgtttagatctcaaacaagatgtatgcgaaatgccaaaagaaactggcccctgcctggcttattttcttcattggtggtatgacaagaaagataatacttgctccatgtttgtctatggtggctgccagggaaacaataacaacttccaatccaaagccaactgcctgaacacctgcaagaataaacgctttccctgattggataaggatgcactggaagaactgccagaatgtggctcatgctctgagtactgttcctgtacctgacggatgctccagactggcttccagtttcactctcagcattccaagatcttagcccttcccagaacagaacgcttgcatctacctcctcttcctccatctttggctcttttgatgcacaatatccatccgttttgatttcatctttatgtcccctttatctccaacttctagaactcccagtttatacctgtgtcactctcaattttttccagtaaagtacttgatgtagtcctgtgccttgaggctgagtgattgacatctttttggcacattacactttgcagagtaagggatcattgaggcttctggtgacatcattcaagggagtgaagacaatcagaactttgagagttcagagttccaggaatattgttattgttatcttcctctgtttctacaaaagattgtaaaaccctttttaggcaagggcccaaggacagtgccttagtttggatcctctagaaactaaccctgggaaaagggcatgggtgcaggtagtttgtttgagagatttcccaggacatacaagatggggagtgagatgagtaattcagggaagagaagggaagagagaagagtctattatgagctggttactactgtggctcaatcctattggggaccttttaaagaatcatgtaaaacaggcttacaaattttctttttaaaaatattttattttattttacgttccgggatacatgtgcaggacctgcaggtttgttacataggtaagcctgtgccatggtggtttgctgcacctatcaacccattacctgggtattaagccccgcatgcattagctatttatcctgatgctttccctccccctgccccctcaacagtccacgtgttctcattgttcatctcccacttgcaagtgagaacatgtggtatttacttttgttcctgcgttactttgctgaggataacggcttccagcttcatccatgtccctgcaaaggacgtgatctcatttctttttatggctgcatagtattccatggcatatatgtaccacattttctttatccagcctatcgttgatggatatttggtttgattccatgtttttgctattgtaaatagtgctgcagtgaacatacacatgcatgtatctttataaaagaatgatttatattcctttgagtgtatacccagtaatgggattgctgggtcaaatggtatttctggttctagatctttcaggaattggcacactctcttccacaatggttgaaccaatttacattcccaacagtgtaaaagcattcatgtttctccacagctttaccagcatctgttgtttctggactttttaataatcaccattctgactggcatgagatggtatctcattgtggttttgatttgcatttctctgatgatcactggtgttgagctttttttcatatgtttgttggccgcataaatgtcttcttttgagaa

SEQ ID NO: 607 - DNA, 1079 bp, Homo sapiens
tgagtgggggagagagaggagaccaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgggtcttcccccaacagaactatttcttgctgctcaatccatttcctctggcccagcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcatca

SEQ ID NO: 608 - DNA, 1894 bp, Homo sapiens
tggcgggtggggttgtcgacacgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatatt

SEQ ID NO: 609 - DNA, 957 bp, Homo sapiens
tcaacacaacttgcttctctccagacttgggcttaaggctctgataaccatgaggcttctcattctcacctgtcttgtggctgttgctcttgccaggcctaaacttcctcttagatacccagaacgccttcagaatccatcagagagcagtgagcctataccattagaatcaagagaggaatacatgaatggtatgaacaggcagagaaacattctgagagaaaaacagactgatgaaatcaagaactgtgttgtggcagagcctgagaagatggaatccagcatcagttcatcgagtgaggaaatgtctctcagtaagtgtgcggaacagttttgtagactgaacgaatacaaccaacttcagctgcagaagatgtctaagcaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagttttctagtggacattttgtttaaaaagtctttgaattgccagttctgtaagtgccatcaattaaaatagttttgtgcagtgacagagattttcttttttcttttcaataaattacactttaaggc

SEQ ID NO: 610 - DNA, 3963 bp, Homo sapiens
agggcctgtccctctcacttccactcgattgtaatttcatccccgggccggtcgagcctccctccctcccgcggccagcccttccctcccagtcggcctccttcgtcgcccccgcccccgcgaaaagccctgcagcttgcagccggcttcactcgcgcacgccgacctcccggctgcagtcctacctcttggaactacccgtgtttccgggcccagccctcgcagccccccacctcctcgccccggcccggggatccgttggggccgcgtcccccacgcgcccccggagacgccctttccgtgtgcgcccgggacttggtgaaactttgcaggcgccggctgcgaaatggatttaatccgaggcgtcttgctccggctcctgctcctggcttccagcctcggacccggcgcggtgtcgctccgagcggccatccgaaaaccaggcaaggtagggcctcctcttgacatcaagctgggcgcattgaactgtacggctttcagcatccagtggaaaatgccaaggcatcctggaagtcccatccttgggtacactgtcttttactctgaggttggcgcagataaatccctgcaggagcagttgcacagcgtgcctctcagccgggacatcccgaccacggaggaagtgattggagatttgaaaccaggcactgaatatcgtgtgagcatagcagcttacagccaggctggcaaagggcggctgagctctcctcggcatgtcaccactttgtcccaagattcctgcctgcctcctgcagctccccagcagccacatgtcattgtggtttcggattctgaggtggccctgtcttggaaacctggagcgagtgaaggaagcgcccctattcagtactattctgtggaattcatcaggccagatttcgacaagaagtggacctcaatccatgagcggatccagatggactccatggttatcaagggcctcgatccagataccaactaccagtttgccgtgagggcaatgaattcccatggccccagcccccgcagctggcccagtgacatcatccggaccctctgccctgaggaggcgggaagtggccgctatggaccccgttatatcaccgacatgggagctggtgaggatgatgaaggatttgaagacgacttagatttggatatttcctttgaggaggttaaaccacttcctgctaccaaaggagggaataagaaatttttggtggaaagcaagaagatgtctatatctaacccaaagaccatttctaggctcatcccccctacctcagcatctctccctgtgaccacggtggctccccagcccattcccatacagagaaaggggaagaatggtgtggccataatgtcaaggctctttgacatgccttgtgatgaaactctctgctctgctgacagcttctgtgtcaatgactacacctgggggggctcgcgatgccagtgcaccctgggcaaaggtggtgagagctgctcagaagatattgttatccagtatcctcagttctttggccactcctatgtaacgtttgaacctctgaagaattcttatcaggcatttcaaattactcttgaatttagggcggaggcagaggatggcttactgctctactgtggggagaacgaacacgggaggggggatttcatgtccctggctatcatccgacgctccctgcagttcaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcagggccaatacagtaaaattactttccggacacctctctatcttggtggcgctcccagcgcttactggttggttagagcaacagggacaaaccgaggctttcaaggctgtgtgcagtcgctcgctgtgaatgggaggagaattgacatgaggccctggcccctgggaaaagcactcagtggggctgatgtgggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcagagggaggcttcacacagattaagtgcaacacagacattttcattggcggagtccccaattatgatgatgtgaagaagaactcgggtgtcctgaagcctttcagcgggagcatccagaagatcatcctgaatgaccgaaccatccatgtgaagcatgacttcacctccggagtgaatgtggagaatgcggcccacccctgtgtgagagccccttgtgcccatgggggcagctgccggcccaggaaggagggctatgactgtgactgccccttgggctttgaggggcttcactgccagaaagagtgtgggaactactgcctcaatacgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatcaaa

SEQ ID NO: 611 - DNA, 2217 bp, Homo sapiens
tcagcccacttccggggagggaggcagaggaacccctccccgccgctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatc

SEQ ID NO: 612 - DNA, 1047 bp, Homo sapiens
atcccagcagactgtgcagtggggcaaggatttcatgagcatcctcctctaaacgcgtgtcaagacaaaagatgcttcagctttggaaacttgttctcctgtgcggcgtgctcactgggacctcagagtctcttcttgacaatcttggcaatgacctaagcaatgtcgtggataagctggaacctgttcttcacgagggacttgagacagttgacaatactcttaaaggcatccttgagaaactgaaggtcgacctaggagtgcttcagaaatccagtgcttggcaactggccaagcagaaggcccaggaagctgagaaattgctgaacaatgtcatttctaagctgcttccaactaacacggacatttttgggttgaaaatcagcaactccctcatcctggatgtcaaagctgaaccgatcgatgatggcaaaggccttaacctgagcttccctgtcaccgcgaatgtcactgtggccgggcccatcattggccagattatcaacctgaaagcctccttggacctcctgaccgcagtcacaattgaaactgatccccagacacaccagcctgttgccgtcctgggagaatgcgccagtgacccaaccagcatctcactttccttgctggacaaacacagccaaatcatcaacaagttcgtgaatagcgtgatcaacacgctgaaaagcactgtatcctccctgctgcagaaggagatatgtccactgatccgcatcttcatccactccctggatgtgaatgtcattcagcaggtcgtcgataatcctcagcacaaaacccagctgcaaaccctcatctgaagaggacgaatgaggaggaccactgtggtgcatgctgattggttcccagtggcttgccccacccccttatagcatctccctccaggaagctgctgccaccacctaaccagcgtgaaagcctgagtcccaccagaaggaccttcccagataccccttctcctcacagtcagaacagcagcctctacacatgttgtcctgcccctggcaataaaggcccatttctgca

SEQ ID NO: 613 - DNA, 9200 bp, Homo sapiens
atcagaccaacgtgaattgaatcacagcagttcagaaagaggaaactggattcaggacttgaacgcaactcccaattgcagaaaattggcaacgtctctgaagagcccttgcttttgcctggacccccagcatcatggtttcccatttcatggggtctctcagtgtcctgtgtttccttctgctgcttggattccagttcgtctgcccacagccctccactcaacacaggaaggtcccgcagcggatggcggcggagggcgcccccgaggacgacggcggcggcggcgccccgggagtgtggggcgcctggggcccctggtcggcctgctcgcgtagctgcagcggcggcgtgatggagcagacgcggccctgcctgccccgctcctaccgcctgcgcggcggccagcggcctggcgcccctgcgcgcgccttcgcggaccacgtggtgtcggcggtgcgcacgtcggtgccactgcaccggagccgcgacgagacgccagcgctggccggtacggacgccagccgccagggccccacggtgctgcgaggcagccggcacccacagccccagggcctcgaagtcactggggacagaaggagcaggacccgtggtaccattggccctggcaagtatggctatggtaaggccccatatatcttaccactgcagacagacactgcacacacgccacagaggctccggagacagaagctctcatcccgccattccaggtcccagggagcatcttctgctaggcatggctacagttcaccagcccaccaggtcccccaacatgggcctttgtaccaaagtgacagtggccctcgctctggactgcaggctgcggaggcccccatctaccagctacctttgacccatgatcaaggctaccctgcagcttcaagtctctttcacagcccagaaacaagcaacaaccacggtgtggggacccatggggcaactcagagcttctctcagcctgcccgatctacagcaatctcatgcatcggggcctatcggcagtacaagctgtgcaacaccaacgtatgtccagaaagcagtagaagtatccgggaggtacagtgtgcatcctacaacaacaagccattcatgggccggttttatgagtgggaaccatttgcagaagtaaaaggcaatcgcaaatgtgagttgaactgccaggcaatgggctaccgcttctatgtacggcaagctgagaaagtcatcgatggcaccccctgtgaccagaacggcacggccatctgtgtgtctgggcagtgcaagagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaactatttggccctgagaagtcgttctggacgctccatcatcaatgggaactgggcaattgatcgaccaggaaaatacgagggcggagggaccatgttcacctacaagcgtccaaatgagatttcgagcactgccggagagtcctttttggcggaaggtcccaccaacgagatcttggatgtctacatgatacaccagcagccaaacccaggcgtgcactacgagtacgtgatcatggggaccaacgccatcagcccccaggtgccaccccacaggagaccaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggatcgcagtaccctattttccgctgtgtgcacagaagcactcatgaagaggctcctgagagttactgtgactccagcatgaagccgacccccgaggaggagccctgcaacatcttcccttgcccagccttctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcgtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaaggtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatgtgttccaagagctgccagggtggctttcgggtccgggaagtgcggtgtctgtctgatgacatgactctaagtaacctctgtgaccctcagttgaaaccagaagagagagaatcttgtaaccctcaggactgtgtccctgaagttgatgaaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccgaaacactgctgtattagaaaaagtctctttctggtctttctggttttgtttatgaatttccctctgtggccacaaattcctcccctcccccatgactcacagtccatatggcccacccccagacttgagcaccaagctctgcattaatgcagttggcctgcgacaaggagctgtggacccttccccatctcttccaattcactttccccaactatccagttccagaggccgcaggcctggaaggatgcagtgcatattgaaaggtggaccctctgaaaacagttaagaggaatatatgtatgttttacccattaagaaaaaatggcaagctaaacaaatgttaaacttacagaaaatttgtcttatggtcctgagcatatttcccttttagagcaagcctggattcttagcaaagtgtttcccccatttgctcttttagctgacaaatctgccactgtgatgatggtttgcagcttttggaagcagtatggcaacctggcctgacatgctctttaggcttccactaacctggggctttcagaaattctatttggcctttctgtgggtagctttccagcttctcttctagggagccccaggcatcatttcccaaaagcatccccatctcctgattctcttggaactcctacagataagcatcctggcagaggcccaggctcccaaaccgacaaagtgaaaagagaccagagaggccaagcatattgactggtgctgttcagggcctgctcttttccactcaccacttgttttgctgcttgtcacgaggagagttgttcctgtatgtggctgctctcagatctttccaagcaagccagtcatttgaagaggttttcttttcatgctggagggcaggctaagatcaatgagtggaagagagaaaggctgttttagctcaagttaaaggaacaccttctagccatcaaagccgcccaacagaggcaagggccaccacacatgagagagcgctctgtccttaaagggaattctctgttgagtgggaggtgaacaccctggttcttccaactcaggaattctcgtggctgggctgggtcagtgatggctttgtctctttatgtctaaagtgccctatggctgctgaaggttacctaaccattctttaaaaggagaatgaccctccatgggaatggccagcctgccaactgtgcaattgaagaagacccgatggatcaaccccatgtctcccttggggagaaagtgcataaaccaggggtctctttttttttttcaacaaaccattgagctgttcttggagttcatctctggagaggttatacattattagaagtttgattattattatagtttgatcaatttatttgtcttagagatccaatttttactaattccctagttttttatttcagcatctgaatgtctttctccctagcacagtgcatacaatcagggccttgggtatttccagtgataactttccttggagaggatctaagaaaagcccagatttcggtagccatctccctccaaatatgtctctttctgctttcttagtgcccattatttccccctctcctttcttctgtcactgccatctccttcttggtcttcccattgttctttaactggccgtaatgtggaattgatatttacattttgatacggtttttttcttggcctgtgtacgggattgcctcatttcctgctctgaattttaaaattagatattaaagctgtcatatggtttcctcacaaaagtcaacaaagtccaaacaaaaatagtttgccgttttactttcatccattgaaaaaggaaattgtgcctcttgcagcctaggcaaaggacatttagtactatcgattctttccaccctcacgatgacttgcggttctctctgtagaaaagggatggcctaagaaatacaactaaaaaaacaaacaaaaacaccaaaagaaaaaaaaaagccatttaaagccagccactagagggagtcagttcagttccgtaaaggtatgctcagtgcccgctgcctgcaagctgttggggaccccagggagggcaaggcagcctgtccccgcccccagggaactagaacatgacaagaattctccgcactgtgcctacctgtccctttaccttacctctctggcccagagttcttggagggttttttctttattttcttatgtactcatctacttattctcaaagtatttagcattcaacactctttttgctttaaaaagaatggccttacaaagggacagaaaagagaagacacgagcttggtgtattttcatcaagttatgtggcagagaaatccagatattaccaggacctgtctaaacaaatgttgtgggttttcttttcattcggatagccactttatagttggaatatcaattctaatgaggaggaagacataaatataagtggtaaaaagaaacatgacttcccttaaaacaggctggataatctatatcagccttgtgggtggagactagtatttgatccttgccatataaaacattttaatatggtttacatgggaaaatatcgatggcttcctcacaaaatgtatgggtgacgtgaagttgaagagccaatggcttgggtgacacgtgctggatccaaaaagatcagggagactagaataaaacttggatgttaaaaattcaccaggaatccacataaagtactatatttgggctaaaatgaaaaactaaatacaaggtgggagagaggcaagaatttcagttgactaagctcagtgtgagtcaaagtgggatggaaccatgcaaaaacaaaacccacagacatgcaggctacgtgaggagaaaacagtggtgaggatcacatcacattgtgtttgcatttgccggaaccatactttaagaagaaaaccgatcatctataataacatcagtttatcaatgccccgtcctgatgaagtgtgcagactctcagaaacagcaggaaggacttcatgagaaccctcaggctggagaaggcactagggcacaaggagagctctcctaggaccaggaccaagaagctacaggcaggcacagtttagctcctgcagagacccagcttttcacaagttggagccttccagagatagagggactgtggtaggtggtgacccacccatcactggaggtggaagcagaggccgtttgccagggatgctggagaggggattcaagcatctggctgggcaacgtgatgctcagggccgtctccactcagggcttaggggagtctgtgagtagaagagctttaggtgatttgtttggtgggggaaggcaagtacacagctatgcactttccgtttctgacttttgccaccctgtcagccatggggagcccactgtgggactgaaaccctgagctgaatgcggcctcatgtctcagagaaacactggcaagttggtcagagccgccgtctgcatcgaggcgtagctgagcggcaggatggggggctgcctgcccagggtctctcaccgtggtgtaagcagagccatggcttgcctaggaccctatagataccatcactctttctcagctcgactggagtttctgcacctttgcaggggcaaagtaactccctgcaccctgaaccaccccccattcctgttcatttcagcagataatgatggagggggggggtgtccatcgtgctgagggtgtgaccgcaagagggtgaaaacttccagccaactttctcagtcctttctcttgcgagagggaagccacctgctatacaaactaataccccctgccttgaccccttccccacgactcagttgacagaaggatatactttgttataacttattattttgttctctgtaaatacaagatgtttataggaaatatgtattctgaactctatctgcagaatgagtcactacaccaaaatagttctattatttagaatgtgttaattttaaagggacctgataggtatttatttacatatgcgatccacatttgtgtgaaagcatgtgatcatactaacccagcctcctggaatgtcgctgtacgatgattgatgtctttttctcagtccatagttacaattgtttagtatgctaatcagtccagttccctgaggtttaagatcaaatataaattactctgcttttcgactcattcaggtagcattgtacctgaacctgattgctactttttcatcttaaatattatatttcctcatctaatctgccttcccctcatccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatctgctttgttgacaagcgtgtgctttctctggccttattcgcgttctgttctcctgcaaatagcgccctctaaaaagaagagtcagacaataaactggttgaaatatc

SEQ ID NO: 614 - DNA, 2060 bp, Homo sapiens
atgtcatagaattctcaaaacttcctaactgcttctctctctctcttttactcttattctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgagagatggaagctttgatgctcacaaggggctgccctggcaaacctcctgagagaaaagaaaagctaagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaac

SEQ ID NO: 615 - DNA, 917 bp, Homo sapiens
tgcaggaaagcctcaagtagaggagggttgaggcttcagtccagcacctttctcgggtcacggcctcctcctggctcccaggaccccaccataggcagaggcaggccttcctacaccctactccctgtgcctccaggctcgactagtccctagcactcgacgactgagtctctgaggtcacttcaccgtggtctccgcctcacccttggcgctggaccagtgagaggagagggctggggcgctccgctgagccactcctgcgcccccctggccttgtctacctcttgccccccgaagggttagtgtcgagctcactccagcatcctacaacctcctggtggccttgccgcccccacaaccccgaggtttaaagccaggtacacgaggcaggggacacaccaaggatggagatgttccaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtccatcccgactcccggggccctcggacaccccgatcctcccacaataaaggcttctcaatccg

SEQ ID NO: 616 - DNA, 389 bp, Homo sapiens; identical to SEQ ID NO: 514

SEQ ID NO: 617 - DNA, 1357 bp, Homo sapiens
gagaaacagaatcctaactatttctgaggaaactgacttggcaacaagcattttgagaaatttattctgcccttgaacatctttgagcccattgagatgttctccaacgcaaacagcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggcatcaacaaa

SEQ ID NO: 618 - DNA, 3506 bp, Homo sapiens
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaa

SEQ ID NO: 619 - DNA, 1802 bp, Homo sapiens
ggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaagctttcacctctgtgcagctactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaa

SEQ ID NO: 620 - DNA, 1791 bp, Homo sapiens
gccgagccccgcccagtagtccccgcccacgcacctgaccacgcccacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgc

SEQ ID NO: 621 - DNA, 2223 bp, Homo sapiens
ggggacgcggagctgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggaggaatccgacacgtgacggtctgtccgccgtctcagactagaggagcgctgtaaacgccatggctcccaagaagctgtcctgccttcgttccctgctgctgccgctcagcctgacgctactgctgccccaggcagacactcggtcgttcgtagtggataggggtcatgaccggtttctcctagacggggccccgttccgctatgtgtctggcagcctgcactactttcgggtaccgcgggtgctttgggccgaccggcttttgaagatgcgatggagcggcctcaacgccatacagttttatgtgccctggaactaccacgagccacagcctggggtctataactttaatggcagccgggacctcattgcctttctgaatgaggcagctctagcgaacctgttggtcatactgagaccaggaccttacatctgtgcagagtgggagatggggggtctcccatcctggttgcttcgaaaacctgaaattcatctaagaacctcagatccagctgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttggatattggaatggtgccgataagaagggacgcttccttccgattactaccagctatgactatgatgcacctatatctgaagcaggggaccccacacctaagctttttgctcttcgagatgtcatcagcaagttccaggaagttcctttgggacctttacctcccccgagccccaagatgatgcttggacctgtgactctgcacctggttgggcatttactggctttcctagacttgctttgcccccgtgggcccattcattcaatcttgccaatgacctttgaggctgtcaagcaggaccatggcttcatgttgtaccgaacctatatgacccataccatttttgagccaacaccattctgggtgccaaataatggagtccatgaccgtgcctatgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccgggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctc

SEQ ID NO: 622 - DNA, 2088 bp, Homo sapiens
cctaacctgctgatacagatcagatggtgactgaatagaagctgccccagtcctgggttcatgatgtacgcacctgttgaattttcagaagctgaattctcacgagctgaatatcaaagaaagcagcaattttgggactcagtacggctagctcttttcacattagcaattgtagcaatcataggaattgcaattggtattgttactcattttgttgttgaggatgataagtctttctattaccttgcctcttttaaagtcacaaatatcaaatataaagaaaattatggcataagatcttcaagagagtttatagaaaggagtcatcagattgaaagaatgatgtctaggatatttcgacattcttctgtaggcggtcgatttatcaaatctcatgttatcaaattaagtccagatgaacaaggtgtggatattcttatagtgctcatatttcgatacccatctactgatagtgctgaacaaatcaagaaaaaaattgaaaaggctttatatcaaagtttgaagaccaaacaattgtctttgaccataaacaaaccatcatttagactcacacctattgacagcaaaaagatgaggaatcttctcaacagtcgctgtggaataaggatgacatcttcaaacatgccattaccagcatcctcttctactcaaagaattgtccaaggaagggaaacagctatggaaggggaatggccatggcaggccagcctccagctcatagggtcaggccatcagtgtggagccagcctcatcagtaacacatggctgctcacagcagctcactgcttttggaaaaataaagacccaactcaatggattgctacttttggtgcaactataacaccacccgcagtgaaacgaaatgtgaggaaaattattcttcatgagaattaccatagagaaacaaatgaaaatgacattgctttggttcagctctctactggagttgagttttcaaatatagtccagagagtttgcctcccagactcatctataaagttgccacctaaaacaagtgtgttcgtcacaggatttggatccattgtagatgatggacctatacaaaatacacttcggcaagccagagtggaaaccataagcactgatgtgtgtaacagaaaggatgtgtatgatggcctgataactccaggaatgttatgtgctggattcatggaaggaaaaatagatgcatgtaagggagattctggtggacctctggtttatgataatcatgacatctggtacattgtaggtatagtaagttggggacaatcatgtgcacttcccaaaaaacctggagtctacaccagagtaactaagtatcgagattggattgcctcaaagactggtatgtagtgtggattgcccatgagttatacacatggcacacagagctgatactcctgcgtattttgtattgtttaaattcatttactttggattagtgcttttgctagatgtcaagaagcccttcagacccagacaaatctaatatcctgaggtggcctttacatacgtaggaccaaaccctctctaccatgagggaagaagacacagcaaatgacagacagcacctattccttactcacaagggaaactgcttgtgatacttcctaataagataaataagtggtttccctcaattgaagacaggaacatcattttccacaggatatgaagagctgccagtaatgccaaaatcttacctcatataatacctggagcatgtgagattcttctagtgaaaaagaacagtcttccctgaagactcagggcttcaacattctagaactgataagtggaccttcagtgtgcaagaatggagaagcatgggatttgcattatgacttgaactgggcttatatctaataatacagagcactatctctaacctcaacagttgacattttaaaagtttttaaatgtatctgaacttgctgttaacacagtgttataactcaagcactagcttcaggaagcatgttgtgttgttaagaagcttttctgatttattctttaacagcatcttgccatctatatgttagtagcagttggcccagaaaggac

SEQ ID NO: 623 - DNA, 4805 bp, Homo sapiens
agtccagcagccaccatcaccaccactgcggttgctgctgcagctgcagctgctgctctccctccggctgcttcttcgcgtggccagcagcgaatggagcgatggagcccagactgttctgctggaccactctctttctcctggccgggtggtgcctgccagggttgccctgccccagccggtgcctttgctttaagagcaccgtccgctgcatgcacttgatgctggaccacattcctcaggtaccacagcagaccacagttctagacttgaggtttaacagaataagagaaattccagggagcgccttcaagaaactcaagaatttgaacacacttctgctgaacaacaaccacatcagaaagatttccagaaatgcttttgaaggacttgaaaatttgctatatctgtacctgtataagaatgaaatccatgcactagataagcaaacatttaaaggactcatatctttggaacatctgtatattcatttcaaccaactagaaatgctacagccagagacctttggagaccttctgagattagagcgactatttttgcataacaacaaattatctaaaattccagctgggagcttttctaatctggattcattaaaaagattgcgtctggattccaacgccctggtttgtgactgtgatctgatgtggctgggggagcttttacaaggctttgcccaacacggccacacccaggctgcggctacctgcgaatatcccaggagactccatgggcgtgcagttgcttcagtaacagtagaggaattcaattgccagagcccccgaattacttttgagccgcaggatgtggaggtaccatcaggaaataccgtctacttcacctgccgggcggaaggaaaccccaaacctgagattatttggatacacaacaaccactcattggatttggaagatgatactcgacttaatgtgtttgatgatggcacactcatgatccgaaacaccagagagtcagaccaaggtgtctatcagtgcatggccagaaattccgctggggaagccaagacacagagtgccatgctcagatactccagtcttccagccaaaccaagctttgtaatccagcctcaggacacagaggttttaattggcaccagcacaactttggaatgtatggccacaggccacccacaccctcttatcacttggaccagggacaatggattggagctggatggatccaggcacgtggcaacgtccagtggactttacttacagaacatcacacaacgggatcatggtcgatttacctgtcatgccaacaatagccacggcactgttcaagctgcagcaaacataattgtacaagctcctccacaatttacagtaacccccaaggatcaagtggtgctggaagaacatgctgtagagtggctctgtgaagctgacggcaacccacctcctgttattgtctggacaaaaacaggagggcagctccctgtggaaggccagcatacagttctctcctctggcactttgagaattgaccgtgcagcacagcacgatcaaggccaatatgaatgtcaagcagtcagttcgttgggggtgaaaaaggtgtctgtgcagctgactgtaaaacccaaagctcttgcagtgtttactcaacttcctcaggatacaagtgtcgaggttggaaagaatataaacatttcatgtcatgctcaaggagaaccacagcccataattacttggaataaggaaggtgtgcagattactgagagtggtaaattccatgtggatgatgaaggcacgctgactatctacgacgcagggttccctgaccagggaagatatgaatgtgtggctcggaattcttttggccttgctgtgaccaacatgtttcttacagtcacggctatacagggtagacaagctggcgatgactttgttgaatcttccattcttgatgctgtacagagagttgacagtgcaattaactccacacgaagacatttgttttcacaaaaacctcacacctccagtgacctgctggctcaatttcattacccgcgtgacccactgattgtggaaatggcaagagcaggggagatttttgagcacacgctgcagctgatacgggaacgtgtgaagcaggggctcactgtggacttggaaggcaaagaattccggtacaatgacttggtgtccccgcgctccctcagcctcatcgccaatttatctggatgcacagctcgcaggcctctgccaaactgctccaaccggtgtttccatgcgaagtaccgcgcccacgacggcacgtgcaacaacctgcagcagcccacgtggggcgcggcgctgaccgccttcgcgcgcctgctgcagccagcctaccgggacggcatccgcgcgccccgcgggctcggccttcctgtgggctcccgccagcccctcccgccgccccggctggtcgccacagtgtgggcgcgcgcggcggccgtcacccccgaccacagctacacgcgcatgctcatgcactggggctggtttctagagcacgacttggaccacacagtgcctgcgctgagcacagcccgcttctcggatgggcggccgtgcagctccgtctgcaccaacgaccctccttgtttccccatgaacacccggcacgccgacccccggggcacccacgcgccctgcatgctcttcgcgcgctccagccccgcgtgtgccagcggccgtccctctgcgacggtggattcagtctatgcacgagagcagatcaaccagcaaacagcctacatcgatggctccaacgtttacgggagctcggagcgggaatcccaggctctcagagacccttcggtgcctcggggtctcctgaagacaggctttccttggcctccctccggaaagcccttattgcccttttctacaggcccacccaccgagtgcgcgcgacaggagcaggagagcccctgtttcctggccggggaccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagttgtacggctctccaggtgacattgacctctggcccgcccttatggttgaagacctgattcctggtacaagagtgggaccaacacttatgtgcctgtttgttacccagtttcagcggctaagagatggagataggttctggtatgaaaaccctggagtatttaccccggcacaactcactcagctgaagcaggcgtccctgagccgggtgctttgtgacaatggtgacagcattcagcaagtgcaggctgatgtctttgtaaaggcagaatacccacaggattacctgaactgcagcgagatcccgaaggtggacctgcgagtgtggcaagactgctgtgcagactgtaggagtagaggacagttcagagcagtgacgcaagagtctcaaaagaaacgctcagctcaatacagctatcctgttgataaggatatggagttaagtcatctaagaagtaggcaacaagataaaatatatgtgggtgaagatgctagaaatgtgacagttctggcaaaaacaaagttctcccaagatttcagcacgtttgcagcggaaattcaggaaaccatcacagcactcagagagcagataaacaagctggaggcacgcctgaggcaggcagggtgtacagatgttagaggggttccaaggaaggccgaggagcgctggatgaaagaagactgcactcactgcatttgtgagagtggccaggtcacctgtgtggtggagatttgtcccccggctccctgtcccagtcctgaattggtgaaaggaacctgctgtccagtttgcagagaccgaggaatgccaagtgattccccagagaagcgctaataaaagttttgtgctgttgagccccaaatgggaaatttctcaggaagagacatttaggacttcagaacttttaacttgtagtcacattgttgatatggaaaccactgacttaagcaacttagttcatctaatcttacatatacttacgatcttttattttttcattttctaacataccttgaaataattcaaaactaaaagcaataaagtgcatatgaagtgtttgatcataagaaatatttcttactgtaagctgtcagttttatatgccacacctggaaataaaaagaatatcatggaatatttaaaaaa

SEQ ID NO: 624 - DNA, 1487 bp, Homo sapiens
atatcacctgagagagttcccaagtctacaattgctctactagttactattcagtgtttgtgaaaaattttaatctcagtactgtgaagaagctggaaaaagggatattatggggctaaaagctctctgtttggggctgctttgtgttctttttgtctctcatttttacacacccatgccagacaacattgaagaaagctggaaaataatggccttggatgccatcgctaaaacttgtacatttacggctatgtgttttgaaaatatgcgtattatgagatatgaagagtttatatccatgatattcaggctggattatacccaaccactttcagatgaatacatcacagtgactgatacaacatttgttgacattccagtacgattgtacttgccaaaaagaaagtcagaaacccgaaggcgagctgtgatatattttcatggtggtggtttttgttttggaagttccaaacagagggcttttgacttcctgaatagatggacggcaaacacgcttgatgctgttgttgtaggcgtggactataggctggctcctcaacaccactttcctgctcagtttgaagatggccttgctgcagtcaaattttttcttttggaaaaaattcttacaaaatatggagtggatcccacccgaatctgcattgcgggagacagttctgggggcaatttagcaacagcggtcactcaacaggtgcagaatgatgctgaaataaaacataaaatcaagatgcaagtcttactttaccctggcttacagataacagattcttatttgccatctcaccgagaaaatgagcatggtatagttttgaccagggatgtagccataaaactcgtgagcttatatttcaccaaggatgaagcacttccctgggcaatgagaagaaaccaacacatgcctctggagtcaagacatctgtttaagtttgttaactggagtattcttcttcctgagaagtatagaaaagactatgtatatactgaaccaattcttggaggacttagttattcattgccaggacttacagacagcagagcattacccttgttggccaatgattctcagttacagaatttgccactaacctatattcttacttgtcaacatgatctcttaagagatgatggacttatgtatgttacaagacttcgaaatgttggagtccaagttgttcatgaacatattgaggatggaattcatggagctttatcattcatgacttcaccattttatttacgtctaggtcttaggataagagatatgtatgtaagttggctggataagaatttataaatatgtgatgtgtatgtatagcccttacatagtggattgtaatttgtgatattttgtggttttggagcaaagaacaatgtcatttgagttatctaaatctacatttgcaacatttgtagcagttaatgtgtgtccttgaagagttattaaattttctgacttgcagaccctg

SEQ ID NO: 625 - DNA, 642 bp, Homo sapiens
ggaataatttcagtaggattggcaccagctcttctttatatgtctggtagaatttggctgtgaatccatctggtccagggccttttctggggctccatggttcctagaggcaaggaagaagagccaccagtcaaataggtttcagcacctccaactccaacatcttcaaagcagcgactgggaagaaaaataatccttctgacaacacatattcagacacatatggtcagcctcatgaagctctggatacccatgctcatgacattcttctgtacggtgctactgtctgtgctgggagaaatgaggaagaaaagatatgacaggaaggaattgttacttgaagaatgctggggaaagccaaatgtcaaagaatgtaccaataagtgttctaaagcctttagatgtaaagacaaaaattacacatgctgctggacctattgtggaaacatctgctggataaacgtcgaaaccagtggagattactaaaaccgtagcttcccaccaggctgccacctgtgtgggctgggaaatgtttaagaggtctcatagtagtaccctgtggctacttttaggaacaccagtctatttttactgagagctggacaacagcaaacacttgacaaataaacttatttaccagta

SEQ ID NO: 626 - DNA, 1989 bp, Homo sapiens
gagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaacattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctc

SEQ ID NO: 627 - DNA, 2697 bp, Homo sapiens
tccctcccccctccctgccctcctcctcctcctcccctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaatgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaaaatgcaaagctgactgtgatacctgtttcaacaaaaatttctgcacaaaatgtaaaagtggattttacttacaccttggaaagtgccttgacaattgcccagaagggttggaagccaacaaccatactatggagtgtgtcagtattgtgcactgtgaggtcagtgaatggaatccttggagtccatgcacgaagaagggaaaaacatgtggcttcaaaagagggactgaaacacgggtccgagaaataatacagcatccttcagcaaagggtaacctgtgtcccccaacaaatgagacaagaaagtgtacagtgcaaaggaagaagtgtcagaagggagaacgaggaaaaaaaggaagggagaggaaaagaaaaaaacctaataaaggagaaagtaaagaagcaatacctgacagcaaaagtctggaatccagcaaagaaatcccagagcaacgagaaaacaaacagcagcagaagaagcgaaaagtccaagataaacagaaatcggtatcagtcagcactgtacactagagggttccatgagattattgtagactcatgatgctgctatctcaaccagatgcccaggacaggtgctctagccattaggaccacaaatggacatgtcagttattgctctgtctaaacaacattcccagtagttgctatattcttcatacaagcatagttaacaacaaagagccaaaagatcaaagaagggatactttcagatggttgtcttgtgtgcttctctgcatttttaaaagacaagacattcttgtacatattatcaataggctataagatgtaacaacgaaatgatgacatctggagaagaaacatcttttccttataaaaatgtgttttcaagctgttgttttaagaagcaaaagatagttctgcaaattcaaagatacagtatcccttcaaaacaaataggagttcagggaagagaaacatccttcaaaggacagtgttgttttgaccgggagatctagagagtgctcagaattagggcctggcatttggaatcacaggatttatcatcacagaaacaactgttttaagattagttccatcactctcatcctgtatttttataagaaacacaagagtgcataccagaattgaatataccatatgggattggagaaagacaaatgtggaagaaatcatagagctggagactacttttgtgctttacaaaactgtgaaggattgtggtcacctggaacaggtctccaatctatgttagcactatgtggctcagcctctgttaccccttggattatatatcaacctgtaaacatgtgcctgtaacttacttccaaaaacaaaatcatacttattagaagaaaattctgattttatagaaaaaaaatagagcaaggagaatataacatgtttgcaaagtcatgtgttttctttctcaatgagggaaaaacaattttattacctgcttaatggtccacctggaactaaaagggatactattttctaacaaggtatatctagtaggggagaaagccaccacaataaatatatttgttaatagtttttcaagttttgttcactctgttttattgtttgttttattgagaaattcttactcttagagactcatgaattaagaaagagaattctgctaactcagagaacctggttcctatgtaattcagaatatattacatttctcagtaatatttgttttttgaatccacctttatctgagccaatggagatttacttatagcgtattaggagatatttattccattttcttattttaatcaacattctaattatagacacatgggcct

SEQ ID NO: 628 - DNA, 294 bp, Homo sapiens
atggccaaatctttcccagtattctcacttttgtcctttatcttgatacatttggtgttatcttctgtttcaggccctagacactggtggccaccacgtggaattattaaggtgaaatgtccatatgagaaagtaaacttgagctggtacaatggaacggtcaacccctgccctggcttatatcaacccatctgcggcaccaattttataacctatgataatccctgcattctgtgtgttgagagcttgaaatctcatggaagaatcaggttttaccatgatggaaaatgttag

SEQ ID NO: 629 - DNA, 1268 bp, Homo sapiens
ccaggcaggggagcagatgagggaggagccttagagctggagcaaagtgaggaagctgtctccatagggaagaggcctgatgtggactgtccgaactgaaggagggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaataacggagttttgctcttattgcccaggcgcaatctcggctcactgcaacctctgcttcccgggttcaagtgattctcctgcctcagcctcccaagtagctgggattacaggtgcccaccatcatgcccagctaattttttgtatttttagtagagatggggttttaccatgttggccaagctggtcacaaactcctgacctcaggtgatccacccacctcagcctccgaaagtgctgggatcacaggtgggagccactgtgcctggccagttatttcctttttaagcctatttcctatccatttatagctactactgaaaatgactactgaattttatcaaataccttttaagcatacagtcacataatgatttttctcttctaatttgttggcataataaattactaaattttcttgagccatccttgcattcttaataaacttaattgcagactgctgt

SEQ ID NO: 630 - DNA, 2241 bp, Homo sapiens
cgcgagcgccccgggaggggaccggggctgccgtccctccgcctcttcccccgcggggcgtagcgatggcccgggccagggccggggcgctgctggcgctttgggtgctcggggccgccgcgcatccgcagtgcctggacttcaggccgcccttccggccgacgcagccgctgcgcctctgcgcgcagtactcggacttcggctgctgcgatgaggggcgcgacgccgagctgacccgccgcttctgggccctggcgagccgcgtggacgccgccgagtgggccgcgtgcgccggctacgcgagggacctgctgtgccaggaatgctcgccgtatgcagcccacctctatgacgccgaggacccattcacgcccctgcgcacggtgcccgggctctgccaggattactgcctggacatgtggcataagtgccgggggctgttccgtcacctgtcaactgaccaggagctctgggcgctggagggcaaccttgccaggttctgccgctacctgtccctggatgacacggactactgcttcccttacctgctggtcaacaagaacctcaactcaaacctgggccacgtggtagccgatgccaagggctgcctgcagctgtgcctggaggaggtggccaacgggctgcgcaaccccgtggccatggtccatgccagggatggcacccaccgcttcttcgtggccgagcaggtggggctggtgtgggcctacctgcccgaccgctcgaggctggggaagcctttcctgaacatcagccgggtggtgctcacctcgccctgggagggtgacgagcgtggcttcctgggcattgccttccaccccagcttccagcacaaccgcaggctctacgtctactactcagtgggtatccgcagcagtgagtggatccgcatcagcgagttcagagtctccgaggatgacgagaacgccgtggaccacagctctgagaggataatcctggaggtcaaagaaccagcctcaaaccacaacgggggccagctgcttttcggggatgacgggtacctctacatcttcactggagatggcgggatggccggagacccctttgggacatttggaaatgcccaaaacaagtcggcgctgctgggcaaggtgctgcgcatcgacgtggaccgtaaggagcgcggcctgccctacggcatcccgcccgacaacccgttcgtgggcgaccccgcggcgcagcccgaggtctacgccctgggcgtgcgcaacatgtggcgctgctccttcgaccgtggcgacccctcctcgggcactggccgcgggcgcctcttctgcggcgacgtgggccagaacaagttcgaggaggtggacgtggtggagcgcggcggcaactatggctggcgcgcgcgcgaagggttcgagtgctacgaccgcagcctgtgcgccaacacctctctcaatgacttgctgccgattttcgcctacccgcacacggttggcaagtcggtcacagggggctacgtgtaccggggctgcgagtaccccaacctgaacggcctctacatttttggggatttcatgagcgggcgtctgatgtccctccaagagaacccagggacaggccagtggcagtacagtgagatctgcatgggccacggccagacctgtgagttcccaggcctcatcaacaactactacccgtacatcatctccttcggggaggacgaggccggggagctgtacttcatgtcgacaggggagccgagtgccacagctccacgcggagttgtctacaaaataattgacgcatccagctgtaaggccagaagcgccatgcccggctatgtcccagctccttccgtgtgcagctcattgacgtctcagccgttcattttacagtggtggaaatgagcacaaagacacgaagtcatgggcctggggcccagggccagggtggggcccaggccactggctccagagccctgccctaaccccttggctgtgtgccttcacctcaccctcttcaagcaccttccccaacccacgttgccctccaggcctctgtccagcccttcctcagctctcatcactcagacttggtaatccctgggctacacgactgactctctcccagctgctctgggagtctcagggccaagcctgtatctcttcactctgcagaggccgcccaggtgctgggaatggcacggagcagagactcaggaacacttgatgaataaatgagtgatcagctttctaa

SEQ ID NO: 631 - DNA, 938 bp, Homo sapiens
gaggagccagagagagctgcggagagctgccagctgcagcgggcgtgttccgcagctgtaggcacctgtcgtcctgccttcgatggctcctccctccgtccccctggtcctcctcctcgtcctcttgctgagcctggcagagactccagcatccgcacctgcccaccggggacgaggaggctggaccctcaatagtgctggctaccttctgggtcccgtcctccaccttccccaaatgggtgaccaagacggaaagagggagacagcccttgagatcctagacctgtggaaggccatcgacgggctcccctactcccaccctccacagccctccaagaggaatgtgatggagacgtttgccaaaccagagattggagatctgggcatgctcagcatgaaaattcccaaggaggaagatgtcctgaagtcatagatgtcttcaaatccctgttcctatccttcttctccagctcctcctgctccctctgaaaccttttctaggtaccctatgctgagactaagatcctgaagttaaatacccaggtctcatgaagacattgtaaagcatttgaattattctaaaaaatttctggagtttcttaggttttattgattcatccttgaaatcagtataatgtgctattaatggaaccaatagtaattcgaggactagttgggagattctggggtaatcagggaatattcctgcaacacatttaaaggaattgtgttcttttggaatcatcccaattataacacgagctattgcataatacaaataaccctcttaagtctgagagtctgtgtctttatttgaaaagattcttcaaattgcgtacttactcctccatattctttcaacccacatgagtctcctcgagaagtgaggagaggcagtttggagcagaatggagagaataaaatgtttcttgtcaaac

SEQ ID NO: 632 - DNA, 6052 bp, Homo sapiens
gtggcggcagcggcagcagcggcggctccattccccctcctcccccgggagcggcggcggcggccgggccggggccccagcgcgggccgggagggggcacggcggaggccacggaggcaggcgcgggagaagaccgcgctccgcttcccgggccgcgccgacctgctcggcggcctgcccgcccgcgcccaggggccccgaacggtggggccgggcaggcggctgaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggcagta

SEQ ID NO: 633 - DNA, 3403 bp, Homo sapiens
agaacagaggctgagctcgaagcgccgggcagtacagtgagggagagccgagggaaccagcgcggtgcctagcggaactccagggctggaatcccgagacacaagtgcatctgctagctgttagcacttggcagacggagttctcctctagggtagttctaactttgggtaataatgtttgtcagctacctgatattaacattgctccacgttcaaacagcagtgttagcaagacctgggggagagagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaactatttggccctgagaagtcgttctggacgctccatcatcaatgggaactgggcaattgatcgaccaggaaaatacgagggcggagggaccatgttcacctacaagcgtccaaatgagatttcgagcactgccggagagtcctttttggcggaaggtcccaccaacgagatcttggatgtctacatgatacaccagcagccaaacccaggcgtgcactacgagtacgtgatcatggggaccaacgccatcagcccccaggtgccaccccacaggagaccaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggatcgcagtaccctattttccgctgtgtgcacagaagcactcatgaagaggctcctgagagttactgtgactccagcatgaagccgacccccgaggaggagccctgcaacatcttcccttgcccagccttctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcgtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaaggtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatgtgttccaagagctgccagggtggctttcgggtccgggaagtgcggtgtctgtctgatgacatgactctaagtaacctctgtgaccctcagttgaaaccagaagagagagaatcttgtaaccctcaggactgtgtccctgaagttgatgaaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccgaaacactgctgtattagaaaaagtctctttctggtc

SEQ ID NO: 634 - DNA, 1088 bp, Homo sapiens
tttgcccgactggccgcgcacccagctggcccgcccctgcccgacacgaccgctgcccgccccttgccttcctgacccaggggctccgctggctgcggtcgcctgggagctgccgccagggccaggaggggagcggcacctggaagatgcgcccattggctggtggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaa

SEQ ID NO: 635 - DNA, 2489 bp, Homo sapiens
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaaacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgc

SEQ ID NO: 636 - DNA, 1918 bp, Homo sapiens
acagtgggcagcccgattttctgctgagtaggcgctgtgatttcagaatgtctgggcgaggtaaaggtggcaaggggctgggtaagggaggcgccaagcgccaccggaaggtgctgcgggacaatatccaaggcattacaaagccggcgattcgccgtctcgcccgacgtgggggcgtcaagcgcatttctggtctcatctacgaggagacccggggagtcctcaaagtcttcctggagaacgtgatccgtgacgcggtgacttacacggagcacgccaagcgcaagaccgtcacggccatggatgtggtgtacgcgctgaaacgccagggtcgcaccctttatggtttcggcggttgagctgtccccacagcttctctacagactccaaaaggcccttttcagggcccccaaactgtcacagaaagagctgttaacacttcctagataacggaccaagtctagctctgccaccgaggctggagtgcagtggcacgatctcgcctccgcctcccgggttcaagcgattcacctgcctcagcttccggagtagctgggattacaggcctgcgccaccacgcctggctaatttttgtattttttttttttttggtagatacggggtttcaccatgttggccaggctggtcttgaactcctggcctcaagtgattcacccgcctccgcctcccaaagtgctggcatttcaggcgtgagccaccacgcttggtcttgctctagctattctaaacatgaagaagtcatatagcttccttggtgcggtgggctgaagtcactctaagggagtttcccagccccaggggttaaagaactggagtcaagattggaacccagctggcgaaggattccgcaccgctagatcttgacatttgcctcttcttctgccaggaaggctcccctgttcctttttgctgacgtgtcatttctaagtactttctcctactccataaagacttcaagtgagtacacaatactggtgttagtttaatttctaagacagtgagacactcggagaagttcaattttctttaatgcaagtgaaaaattgagttacttaaaagaaatagagtctggcatactttcgtgccctcgatatttgttgcatgaccaaatgagtgattttgggtttcacataaattaaggatgaaagttagggccccgatggaggatagaaatactgtagatatttgtatgacaattaaaactcttccttaagtatttaacttatatggaattgtttaaatatttcatggttttggggtttttttttatttttgtagtggtctcaattctttgattagaatagaacttatattttcccttgtagcatagttatttttttgtttgtgttttgttctttataaaatataacctaattatctaaacccaagaaatatttatttttgtctgtgactctgagtcctatggtatagtaagtacccagtcctgacagtaatcatatcttccaaaccaaaactgggtcacacggttcaataactgaacagaatatctcaaactgaaaacgatcaagattttctgaagtttactattaatagtaaaattgcttactaaaaatgttaaagaacttgatttaaaactctgtaatgcctcacttaaaatgtgaatgaggggggcggggtgggggtggctataatgccagcactttgggaaggctgaggcagtaggattgctggaggccaggagtttgagaccagcatggccaacatagtgagaccccatctctacataaaataagaattataaaatgtaaagtgaatggaatgcattgaaatttgatcctgtagcaaagtcatcccttttgaattttgaacatttgtttaatgcctcttttccaagcatattttgaatattcagagataaatgagcaagttactgcca

SEQ ID NO: 637 - DNA, 4885 bp, Homo sapiens
ggactccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagcagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccggaatgaatggactagtgacacaatagtcctttcccaaaaggagcacctgccagtcactcagattgtgatgacagacgcaggccgaccacattccgaagcagcttatacactggggccactgctctgccgcggagatcagtcattctggaattcagcttccttcaacactgagacttcataccttcatttccctgctttccacggagaactcactgctgacgtgtgcttcttttttaagaccacagtttcctccggggtgtttatggagaacctggggatcacagatttcatcaggattgagctgcgtgctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatgggccgttctgctccaatgagatttccgcatattttgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagctgtggtcatggtagaggtaatcccacaaatgcaaaagtcaaactaactaatattattattttaagaacaaataatctaatgaaaaaatttgataatattaatagaagagcaacccattcagtgctgctcttccataagtcaagaagaagccaaatatggccaggatctgggagagaggaggtggttgtttattctgtattgctttgttttgtttgtttagcaatgcaattctgtcaaaggtattattaatattttactatttaaaatatcaaaatatctatttgttttactttactcaataggggaatgttctctagtttatcatagtgactgctggtggaatctattcattgatactgcagtgggaacttgtcttattctgattataaaagaacaaatactttagcaacttaaaaacacggtttaaaagcacacaacatagttattaaaatgggaataagtaagaaaatagacctgagtcaccacagaggaagtaaattacacattgtcatcggcattggaaggaaaatatactgtatagagaacaacaatgcttggttttatgtttcagattttctccacagaatgagtacatatttaagtttaaaacaaccaattccatctttttcatggattctgccaattatagatccttccattatgaagaagagtaaagccagcaagtgggtacatcgtggatagagtggtagctgatggcatcataggaattgcttataaaatagcttctctttctaaatgattaattatttgaaggtggcttcttgagcttttgtaatggtacttaaaagtgatttattttcatctttcctttcctcatcttcctttgcttccttatcattaaaattgtactttctgttgatgtttgcttctcatgggacatctaataggttaaccagagcacaaagaaacaagtcatcttgtcctcagggacagaattcaacgccgtcaaatctctcatattgggaaaggttttaggtaagtaggagaaagagctttttcccaaataagtgtcatgtcacaaactctggaagcattcatcatgctgaaagaagctccttgtcttacttgaataataatttcacagtgagtgacaatcaaggtgcaaactgtactcttgcctgagtgtacatataatcatgactaagtgctacctgtgagatgtgcaagggcgttcctggaaaaatacctccacacttaacctctcacttggcaatcatgcataatgaatcacggtatttttctaatccttcttgaaaagtgaaatgttgtcaaagctgacacgaagttcacagattatgtatgtattaatcaacatcaactccggagaccatcattcaatgataaaactacgtttgagttgaacacaagagaaaaaactggtaatcttattacagcagatgaatacagttttatttttctctcaagccctgctttgcctgttgtttccatcctttttgactttagtatctaacaggaatggggaggcatattcataaatatctgttacgcaaggtagaaagttacagtaattgtctatcatattgtctatcataatctgttgtaaaagcacagttagctttacatttaataaaggaactgaggaaagtaatctttttttaaaaaaacccatcttatgtaactcaattaagaaaatgaactatactttaatattaggatcaaaaagttgaataatatttattatatacatctttgtttccttccaaataaaggaga

SEQ ID NO: 638 - DNA, 2225 bp, Homo sapiens
agagggaggggccgggggccggggaggttttgagggaggtctttggctttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 639 - DNA, 2638 bp, Homo sapiens
aaagacacaaatcgcctcccggagtggcgcctccagtcgcggcggagcgcggcgttggcggcggatggagggcgcgagcgggcggccgcggaggctgcacccggcggggcgctgatgcggcgcctggaccttcgctgcgcgacttcgggggcgtcggccgagttgggactccgcgatgcagctcctgaaggcgctctgggcactggcaggggccgcgctctgctgcttcctcgtcctagtgatccacgcgcagttcctcaaagaaggtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacgcaagaatcatcaagaccaagcagtggtgtgacatgcttccgtgtctggagggggaaggctgcgacttgttaatcaaccggtcaggctggacgtgcacgcagcccggcgggaggataaagaccaccacggtctcctgacaaacacagcccctgaggggccccgggagtggccttggctccctggagagcccacgtctcagccacagttctccactcgcctcggacttcacccgttctctgccgcccgcccactccgtttccctgtggtccgtgaaggacggcctcaggccttggcatcctgagcttcggtctgtccagccgacccgaggaggccggactcagacacataggcggggggcggcacctggcatcagcaatacgcagtctgtgggagcccggccgcgcccagcccccgccgaccgtggcgttggccctgctgtcctcagaggaggaggaggaggaggcagctccggcagccacagaaggctgcagcccagcccgcctgagacacgacgcctgccccaggggactgtcaggcacagaagcggcctcctcccgtgccccagactgtccgaattgcttttattttcttatactttcagtatactccatagaccaaagagcaaaatctatctgaacctggacgcaccctcactgtcagggtccctggggtcgcttgtgcgggcgggagggcaatggtggcagagacatgctggtggccccggcggagcggagagggcggccgtggtggaggcctccaccccaggagcaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaagttatatatttaacagtttttatatgttgtatatttgtagaaaatcctatttaacaattaacgtggcagtcccggccgtcctgagagtcgggccgagccccgtgtgtttctgaagactctgggggtgggacacggcggggaggtggtgccccgcggaccccggggtgccaggcacggaaggcgggactctgggagaagcgtgcggaggaccgtggcgtcggcgtcccggatgtgtcggtcgtgcccggggaggccgggttcccctcgctgcgggccaggcttggctcctgattccctctctggtccctgtattggtcaacacttgagcgtacaatatcttgaacatgcttcttccaatgggttttgtttcccatttcctgcccctttcgccactcacggaccttgaggccagttgacggcccttctccccacgcctgtgtccccgcgttctgagaagtcctctgtcttcgtgtcactaggtccagaaagtcgcgccgggcagaggcgcaggcggggccggcagggccgaggaataagcgacaattctggtttttctcccctggccgtcgttcgccagcctccttcattttcctgagttcccgctgaagtatatactacctatgagtccaattaacatgagtattatgctagttctatcctactaaaaaaaacgtaaaaaaataactatatagaagctgttccagcaaccatagactgaagatacgaaagaaaatccatttatttaagacctgttccggtatccatgaggacataatttacctttcagtcaccacaaatttataggcatttgtatcctggactaaaagaaggggctgaggttgggtttgtcatcacagagggggtgggcctggaaagggtccttcccaagctgccccggctccggcggcccgggccggcagcctctgccagccagcgtcctcacggcctccccctcgcctgtttcttttgaaagcaagtgtagacaccttcgagggcagagatcgggagatttaagatgttacagcatatttttttttcttgttttacagtattcaattttgtgttgattcagctaaattatgaaaaataaagaaaaactcctttgataa

SEQ ID NO: 640 - DNA, 6760 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgc

SEQ ID NO: 641 - DNA, 1657 bp, Homo sapiens
caacttgctccttccacaggaagctgcacctgacagaagctccaggatgcttgttctctttctcctgggcacagtctttctgctctgcccatattggggtgaacttcatgaccctataaaagcgactgaaataatgtgttatgaatgtaaaaaatatcatcttgggttatgctatggtgtcatgacatcctgctccctgaagcataaacagtcctgtgcagttgagaacttttacatccttacaaggaaagggcagagcatgtatcattattcaaaactgtcgtgtatgaccagctgtgaggacatcaacttcctggggttcacgaagagggtagagctcatctgttgtgatcatagtaactactgcaacctccctgagggagtttagttctacgtctctcctggattttgggttctttttcaaccactacgctctttttctcttccctgaacctgaattttgctctcctcttctatgcattggtagagagtgagaaagccagctcatagtgaaaagacaagcaggcataaggagacgcagtgtggacagcggagcctattgatgatggagcactagactcactctttgcacatccctgtcgctaacaggtgggaggggttttgctctccttacgtgatactgccatgaataagctcagacttggtcatttattatctcctgtatgaaaatgtgaacacttgggccataataatctccaatttgtactgagaattctgtgactatcctctatcctcatctacacacacactcctctccgttggaattctctttggattagccctgacactttctggcactgtccttttctgcccgtgggttctggagagggctaaccccagcttcccagtgtgttggcagcatgggccaagtctttctctgatagagctcttgggggaacctcagggcagaaaaaaaaaaactgaacagacatagggatgagcatcaaagaaaacttcagggggcatttcaactggtaaaaactaagatctgagaaataacttgctgtgggtggaattggcttgaattatcattgccctggctggccaggcagccttgggcacatggttgaactaggtgattggattgggaacagagtgtttttttaaggatggctagtcaggttcttctcatgggactgagcaaacaaaatgctgataatgtggcaggtggtgtagtagttgaagataataggatgtaaatagataccatgaggtagtgttcaagtaacagagtgccctgtgtaagaggaagttatgagtttgcagaaagtgtgagaaaggtagcatatatgggtaacagtggtgggaagagaagaaggaagacacagaaacagataggaagagaaactgagtagcattgatgttggagcacacctgtggccaaggtggcacattttccttggatacacactaaccctggtgtttctgtccttataaggctgactgcaccctagatgacgggttgatgggtgcagcaaaccaccatggcacatgtatacctatgtaacaaacctgcatgctgcactttctttcatgtatcccagaacttaaagtaaaataaaaaaataaataaataaataaaggccagaaaaattggccaaaaaatctgaatagaaaaagatatacagatagtaaa

SEQ ID NO: 642 - DNA, 7308 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccgtcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactg

SEQ ID NO: 643 - DNA, 1217 bp, Homo sapiens
tggccccaggcaccgcctcccgttcccgccccgcgccccgcagcgcttaggcttcggcacactgaggaccgagtcccagtgcagctccagccgacccccgggacgtagacaagggcaggcgcgcggtgaagactgcggccggccgcgtagccgcgctgtggtcccgctggccttctcttgggccgcgcaccctccggacctgcgtcgggatcctcccggagtctcccgctctctcctcccggcttgcgaacatgcggccccttaagcccggcgcccctttgcccgcactcttcctgctggcgctggctttgtccccgcacggagcccacgggaggccccgggggcgcaggggagcgcgcgtcacggataaggagcccaagccgttgcttttcctccccgcggccggggccggccggactcccagcggctcccggagcgcagaaatattcccaagagactctaacttaaaagacaaattcataaagcatttcacagggccggtcacattttcaccagaatgcagcaaacatttccaccgactctattacaataccagggagtgctcaacgccagcttattacaaaagatgtgctagattgttaacaagattagcagtgagtccactgtgctcccagacctagcaaaactaccctacatttcctaagaatgtacatctaatttgaagaaaaagtgcctcaaatcatgcaaaatgtaaaaaaagatgaaatttatatttttatggatattaagatgagtaaaataagagacttcccagaaataactggttagctgtttcctgtcatagaatggagtctttcttgctttatctttttgtgtatacagtaatttataattttgtaaaacagagtttgaatcgcatattgaaaattagatattaaaaattgtgtgattgtattttatttttactagatatattattttctttatatggttaacattctaattaaacatttaattgtgtaaattatatctgtgagtgccagtgagaaataatgatttttttgtatatgactgttagtatatatttgtcaaatcatcgtgtaccaagttaaattttataattcttatttaatatttaaatacatttatttagaacttgttgtcttcacttgcattaatttgaactgtgaattttattaaagttgaaatatgaaaaaatgtgttgtttcctttgaattaaagatgtttgtaataga

SEQ ID NO: 644 - DNA, 434 bp, Homo sapiens
gtcgaatccaaatcactcattgtgaaagctgagctcacagccgaataagccaccatgaggctgtcagtgtgtctcctgatggtctcgctggccctttgctgctaccaggcccatgctcttgtctgcccagctgttgcttctgagatcacagtcttcttattcttaagtgacgctgcggtaaacctccaagttgccaaacttaatccacctccagaagctcttgcagccaagttggaagtgaagcactgcaccgatcagatatcttttaagaaacgactctcattgaaaaagtcctggtggaaatagtgaaaaaatgtggtgtgtgacatgtaaaaatgctcaacctggtttccaaagtctttcaacgacaccctgatcttcactaaaaattgtaaaggtttcaacacgttgctttaataaatcacttgccctgc

SEQ ID NO: 645 - DNA, 2111 bp, Homo sapiens
agctccggccccgaccggaagccccaccgcaccgtcagggacgcggactcgggagtgcgcacattcgcagcccgggcagccctgctgcgcaccgggcctcgcgccccgcgccccgcgccccgcgccccgcgccccgcaccggcctccaggatcatgtggtatgtcagcaccaggggcgtagccccacgggtcaactttgagggggccctcttctctggctatgcacctgacgggggcctctttatgcctgaagagctcccacagttggacagagggaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggaccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtg

SEQ ID NO: 646 - DNA, 159 bp, Homo sapiens
atgaagctctgcgtgactgtcctgtctctcctcgtgctagtagctgccttctgctctctagcactctcagcaccaagtaacaagccccttgaggcaagcaagtctgcgctgaccccagtgagtcctgggtccaggagtacgtgtatgacctggaactga

SEQ ID NO: 647 - DNA, 1319 bp, Homo sapiens
gttgatggcaaacttcctcaaaggaggggcagagcctgcgcagggcaggagcagctggcccactggcggcccgcaacactccgtctcaccctctgggcccactgcatctagaggagggccgtctgtgaggccactacccctccagcaactgggaggtgggactgtcagaagctggcccagggtggtggtcagctgggtcagggacctacggcacctgctggaccacctcgccttctccatcgaagcagggaagtgggagcctcgagccctcgggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcagcctcgcccaccaaggagatccaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacatcgccctggtgaatggaaccacgggagctgtgctgggacagaaggcatttgacatgtactctggagatgttatgcacctagtgaaattccttaaagaaattccggggggtgcactggtgctggtggcctcctacgacgatccagggaccaaaatgaacgatgaaagcaggaaactcttctctgacttggggagttcctacgcaaaacaactgggcttccgggacagctgggtcttcataggagccaaagacctcaggggtaaaagcccctttgagcagttcttaaagaacagcccagacacaaacaaatacgagggatggccagagctgctggagatggagggctgcatgcccccgaagccattttagggtggctgtggctcttcctcagccaggggcctgaagaagctcctgcctgacttaggagtcagagcccggcaggggctgaggaggaggagcagggggtgctgcgtggaaggtgctgcaggtccttgcacgctgtgtcgcgcctctcctcctcggaaacagaaccctcccacagcacatcctacccggaagaccagcctcagagggtccttctggaaccagctgtctgtggagagaatggggtgctttcgtcagggactgctgacggctggtcctgaggaaggacaaactgcccagacttgagcccaattaaattttatttttgctggttttgaa

SEQ ID NO: 648 - DNA, 1497 bp, Homo sapiens
ccggtgggagggaacatctggaacattagacaggatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacagggttggatcctgtagaagcaagtttcgagagtactcctgaagaggtgcgacttgatccctctgatgctgactttgttgatgtgattcacacggatgcagctcccctgatcccattcttgggttttggaacgaaccaacagatgggtcatcttgacttcttccccaatggaggagagagcatgccgggatgcaagaagaatgccctgtctcagatcgtggatctagatggcatctgggcgggaacccgggactttgtggcttgcaatcacctaagaagctacaagtattacttggaaagcatcctcaatcccgatgggtttgctgcatatccctgcacttcctacaagtcctttgagtctgacaagtgcttcccgtgtccagatcaaggatgcccacagatgggtcactatgctgataaatttgctggcaggacaagtgaagagcagcagaaattcttcttgaacacaggagaggctagcaatttcgctcgctggagatatggggtttccatcacactgtctggaagaacagccactggtcagatcaaagttgctttgtttggaaataagggaaacactcaccagtacagtatcttcagggggattctcaaaccaggctcaacccattcctatgagtttgatgcaaagctggatgttggaacaattgagaaagtcaagtttctttggaataacaatgtgataaatccaaccctccccaaagtgggtgccaccaagatcactgtgcaaaagggagaagagaagacagtgtacaacttctgtagcgaagacacagtgcgggaagacacgctgctcaccctcacgccctgctaagctcccggggcgacgaggctgctgcgttcacactaataaaatccactggtgcatctgta

SEQ ID NO: 649 - DNA, 451 bp, Homo sapiens
ggggtgtagaaacaggcctgttaaggagaggccaccgggacttcagtgtctcctccatcccaggagcgcagtggccactatggggtctgggctgccccttgtcctcctcttgaccctccttggcagctcacatggaacagggccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgaccctgtctttcagcaggcccccaccctcctgagcggcaataaataaaattcggtatgctgaattcaa

SEQ ID NO: 650 - DNA, 1173 bp, Homo sapiens
tctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaa

SEQ ID NO: 651 - DNA, 1980 bp, Homo sapiens
aaaggtgcgcgtgttcctttaaggggctggtctggcgggagcgcgggggtttttctgctgccgcttcctttctgcccttttaatttccccgaaatcagactgctgccttggaccgggacagctcgcggcccccgagagctctagccgtcgaggagctgcctggggacgtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccatcccca

SEQ ID NO: 652 - DNA, 919 bp, Homo sapiens
cttacagaactcccacggacacaccatgataaggacgctgctgctgtccactttggtggctggagccctcagttgtggggaccccacttacccaccttatgtgactagggtggttggcggtgaagaagcgaggcccaacagctggccctggcaggtctccctgcagtacagctccaatggcaagtggtaccacacctgcggagggtccctgatagccaacagctgggtcctgacggctgcccactgcatcagctcctccaggacctaccgcgtggggctgggccggcacaacctctacgttgcggagtccggctcgctggcagtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaaccaaaagaagtccctgggactgtttcagacttggaaaggtcacagaaggaaaataatataataaagtgacaactatgcaaatca

SEQ ID NO: 653 - DNA, 1834 bp, Homo sapiens
acaggacccacagatatctgctgccatccacactctccagattggtgtcctgggaccacgtggggatgctgccgtggcttcttgtcttctctgctctgggtatccaggcctggggtgattcctcctggaacaaaacacaagctaaacaggtatcagaggggctccagtacctatttgagaacatctcccagctcactgaaaaaggccttcccacagatgtctccaccacggtctctcgcaaggcatggggggcagaagctgttggctgcagtattcagctgaccacgccagtgaatgtccttgttatacaccatgtccctggactggagtgtcacgaccagacagtctgcagccagagactgcgggaactgcaggcccatcatgtccacaacaacagtgggtgtgatgtggcctacaacttcctggttggggatgatggcagggtgtatgaaggtgttggctggaatatccaaggagtgcacacccaaggctacaacaacatctccctgggctttgccttctttggcactaagaaaggccacagtcccagccctgctgccctgtcggccatggaaaacctaatcacctatgctgtccagaagggccacctgtcatccagttatgttcagccacttcttgggaaaggcgagaactgcctggcccctcggcagaagacaagcctgaagaaggcttgccccggcgttgtcccacggtctgtgtggggagccagggagacccactgtcccaggatgactctcccagcgaagtatggcatcattatccacactgccgggaggacctgcaacatttctgatgagtgccgcctgctggtccgggacatccagtctttctacatagacaggctcaagtcatgcgacattggttataacttcctggtgggccaggatggcgccatttatgaaggggtgggctggaatgtccaaggctcctccacccctggctacgatgacattgccctgggcattaccttcatgggcaccttcacaggtataccacccaatgctgcagcactagaggcagcccaagacctgatccagtgtgccatggtcaaagggtacctgactcccaactacctgctggtgggccacagtgatgtggcccgaaccttgtctcctgggcaggctttgtacaacatcatcagcacctggcctcatttcaaacactgagagaagccccaggtccttctgagactgctttccctcccctgtcaggtctctcctgtcctaaccatccagcttggctcaacaccttttgccctcctcccctgccacacagtcctgtgcctcctttttcaggttgggatgatcatgccctctcctgccaacatcctccaagggcctccaaacctcatagctggacattcacagccctctgagtctgagtccagatttcttctctccttaccttcctctcccttggaaacccaactcctcagccaggtgagacaatgggctggttcttgtttcatttctctctctctctccattcccctctgcctggtgagccttcccctggtgtctgcctggcagcccccacctcccacctatcacccctcacccataactcaggtcaacgtgaccaaccttccttgcttacacataaacttgtatatatttggatgtagcccttatttaatggctgtcattatttatagatatgtctatccttgctacttggttgtgagtttctccaggggaggaactgtgttttattcatctctatgtcctctgtttctcagcagtgtctgaaatttaatgggttctactgatgtttattagagaaatggatgaataaatgaatgaagagatccaaa

SEQ ID NO: 654 - DNA, 612 bp, Homo sapiens
ggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaaggggatgttccaccgggaattagaaataccatctgccatatgcagcaagggatctgcagactttttttctgccattctgggacaggccagcagcacagacaacgctgtggataaggagagtagagacttcctcttcctgcctcctgtcttctggagttgtgacctcagggtggcccaggtggatcggcttcagaggccaggaggcagctctctgcagccgaagagcaggagcctcacccagggtctgtggctctgactaagcctggactgcctctcggctgtgctccatggactggctccccagggatccatgtgagagaccggagtatgatcctcagtgcgaggacaaataaaagtagtgattatgtccacccca

SEQ ID NO: 655 - DNA, 779 bp, Homo sapiens
cacgcctcccgctgccagcccggcaccgggatcttaatcagtcactatgaaaactcattagctccacagcaatgagtcctccactgctgaagcttggcgctgtgcttagtaccatggcaatgatctcaaactggatgtcccaaactctcccatccttggtgggactgaacaccacgaggctgtcgactccggataccttaactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaattgatttaaaaaagagaaaagaagaagaaaaaaggcaacagaaaggagaagcataa

SEQ ID NO: 656 - DNA, 2586 bp, Homo sapiens
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaattggccgggtcttccgctttctcggtgacagttcgctcccttcagcattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaactcttccctcccatcacatgagccacgtggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgc

SEQ ID NO: 657 - DNA, 1712 bp, Homo sapiens
cgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaagaaatgccttca

SEQ ID NO: 658 - DNA, 2508 bp, Homo sapiens
agcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcgcggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtgaa

SEQ ID NO: 659 - DNA, 1973 bp, Homo sapiens
atggaggactcggactcggcggcaaagcagctgggcctggctgaggcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtc

SEQ ID NO: 660 - DNA, 4875 bp, Homo sapiens
gcagccgcggcggcggtggcacagcagcgggcagcggcggctcagggagctggagcctcaacagcctccagcgagcccgggacccgccgacagcccgagaaaccagccgaaggacgcggggcggggtcgccgccgccgccacggggtgctccctccctcccgcccaagtccggccacctggtcttcccctcggccccggccgtctcagactcatcaaaatgaaaccaggaggcttttggctgcatctcacactgctcggagcctccctgccggctgcgctgggatggatggacccaggaaccagcagaggcccggatgtgggtgtgggggagtcacaggcagaggagcccagaagctttgaagtcacaagaagagaagggctttccagccacaacgagctgctggcctcctgcgggaagaagttctgcagccgagggagccggtgcgtgctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaagattggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggctgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctcaaatgctagtaagcagaaagatgctctccgaggtccaactatatccttccctgccttaggccgagtctcgggggtggtcacaaccccacatcccacagccagaaagaacaatggtcatctgagaatactggccctgtcgactattgccaccctgcttctccaagagcagaccaggccacctcatccgtaaggactcggttctgtgttgggaccccaaaaaaccagaacaagttctgtgtgcctcctttcagcacagaagggagacatctcattagtcaggtctggtaccccagattcagggcagactgggcttgcctggcaaggtatgggtggcctccaggctcaatgcagaaaccccaaggacacgagtggggccaggtgagttcctgaagctataccttttcaaaacagattttgttttcctacctgtggcccatccactcctctctggtaccccatccccgcatcagcactgcagagagaacacatttcggcgagggttttcttacccacattccccaatcaatacacacacactgcagaacccagaacagaaggccacaggctggcactactgcattctccttatgtgtctcaggctgtggtgactctcacatgggcatcgaagaagtacaacccacatagccctctggagaccgcctagatcagagactcagcaaaaacaggctcgccttccctctcccacatatgagtggaacttacatgtgtcctggtttgaatgatcattttgcaagccacacgggttgggagaggtggtctcaccacagacgtctttgctaatttggccaccttcacctactgacatgaccaggattttcctttgccattaaggaatgaactctttcaaggagaggaaaccctagactctgtgtcactctcaacacacacagctcctttcactcctgcctgactgccaagccacctgcatcccccgccccagatctcatgagatcaatcacttgtatgtctcacgcaacttggtccaccaaacgcctgtcccctgtaactcctaggggtgcgcctagacaggtacgtctgttttttattttaaaagatatgctatgtagatataagttgaggaagctcacctcaaaagcctagaatgcagtttcacagtagctgggatgcatggatgacccatctcacccctttttttttcctgcctcaatatcttgatatgttatgtttactcccaatctcccatttttaccactaaaattctccaactttcataaacttttttttggaaaaatttccattgtatcagcccctgacagaaaaaggatctctgagcctaaaggaggaaaagtcccaccaactaccagaccagaacacgagcccctctgggcagcaggattcctaagtcaaagaccagtttgacccaaactggccttttaaaataatcaggagtgacagagtcaacttctgcagcacctgcttctcccccactgtcccttccatcttggaatgtgtctaaaaaagcatagctgccctttgctgtcctcagagtgcatttcctggagacggcaggcttaggtctcactgacagcatgccagacacaactgaatcgaagcaggcctgaagcctaggtcagggtttcaggagtccagccccaggaggcaaagtcaccaatgcagggaggtaaatgccttttggcaggaaaaccaatagagttggttgggtggggagtcaggggtgggaggagaaggaggaagaggaggaaggccagactggcctgccctttctcccatacttcaccccagcagaggttcatgggacacagttggaaagccactgggaggaaatgcctcactacaggggggcctcctgtagcaagcccagccggtaatcctcctaatgaacccacaaggtcaattcacaactgatatcttagctattaaagaagtactgactttaccaaaagaatcatcaagaaagctatttatataaaccccctcagtcattttgaaataaaattaattttac

SEQ ID NO: 661 - DNA, 2203 bp, Homo sapiens
agcccagcgctcctccccgcaaatgatcccgccccaggggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatggtgaccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctg

SEQ ID NO: 662 - DNA, 2070 bp, Homo sapiens
tcagcccacttccggggagggaggcagaggaacccctccccgccgctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgtgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatc

SEQ ID NO: 663 - DNA, 2267 bp, Homo sapiens
agcggcatcctctctctagcttctggcgctgcccactgtaacccgactccggcatttgcgtttggggcgccctccctgcgccgggggcgggagcccagcgagcgcagagccccggccccgcgcggcccgagtgccacatcactgcgctggccgtccaaggtccgccgccccaccatgccgcccccgctgccgctgctgctccttacagtcctggtcgtcgccgctgcccggccggggtgcgagtttgagcggaaccccgccggtgaatgccacaggccaccagctgcagacagcgccacctgcgtggacctgcagctcaggacctgcagtgatgccgcctacaaccacaccaccttccccaacctgcttcagcaccggtcatgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacatactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccactgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactt

SEQ ID NO: 664 - DNA, 510 bp, Homo sapiens
ccctggggaagagaagctgagaggaactcctcactcagctagcttcaggagccatgacatcatctctaccatggaaattccactcactctcctgtgcccccacatttgtcctaggcctcagagtccctataaagagagattcccaactcagtatcagcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtggggttcctggggaggaaaggcaagcaagtctgcgctgaccccagtgagtcctgggtccaggagtacgtgtatgacctggaactg

SEQ ID NO: 665 - DNA, 534 bp, Homo sapiens
ggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagggacaggccagcagcacagacaacgctgtggataaggagagtagagacttcctcttcctgcctcctgtcttctggagttgtgacctcagggtggcccaggtggatcggcttcagaggccaggaggcagctctctgcagccgaagagcaggagcctcacccagggtctgtggctctgactaagcctggactgcctctcggctgtgctccatggactggctccccagggatccatgtgagagaccggagtatgatcctcagtgcgaggacaaataaaagtagtgattatgtccacccca

SEQ ID NO: 666 - DNA, 1189 bp, Homo sapiens
agagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcttgcgttagtttgctgagaataatggtttccagcttcatccatgtccccgcaaaggacatgaactcatccttttttatggctgcatagtattccatggtgtatatgtgccacattttctttatccagtctatcattgatggacatttgggttggttcagtttcctctcacaaaggaaattagggaagcaatgaagataataggaatttataagttaggaaacaaaaataatagaatcagtcaatacaagagctgtcgtttgaaagtcctattaaattgataagccattggccaaccaagaaaaaaagggggaagaaaagacatatatttaaaattagaaaccagaaggggaaaataatcacaaacatcagcaaaactgaaaggatctacaggagtaccttgcaaaatagatgtgaataattggatgaaatggttgattttccagaataatgtaaatcaccaaaactgatcccagaatagggaaaaatctaaacagggcaatataaacatagaagaaaatgagaattttagcaaatgagtatctttcaaaaatgtatcaggcccagacctttttacaagttaactctttcaagccttcatgggatataattctgacactactctaactttgtcaaagaatagag

SEQ ID NO: 667 - DNA, 1230 bp, Homo sapiens
agcctgcaaaaaccacagagggcaaagccagaaagatggaaaggcacccatgcagctcaccacttgcctcagggagaccctcttcacaggggcttctcaaaagacctccctatggtggttgggcattgcctccttcggggttccagagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctttggctacgagctgagcagcggcaccaaagagacagcatttatttatgctgtgatggctgcaggcctggtgcattctgtgaccaggtcatgcagtgcaggcaacatgacagagtgttcctgtgacaccaccttgcagaacggcggctcagcaagtgaaggctggcactgggggggctgctccgatgatgtccagtatggcatgtggttcagcagaaagttcctagatttccccatcggaaacaccacgggcaaagaaaacaaagtactattagcaatgaacctacataacaatgaagctggaaggcaggctgtcgccaagttgatgtcagtagactgccgctgccacggagtttccggctcctgtgctgtgaaaacatgctggaaaaccatgtcttcttttgaaaagattggccatttgttgaaggataaatatgaaaacagtatccagatatcagacaaaacaaagaggaaaatgcgcaggagagaaaaagatcagaggaaaataccaatccataaggatgatctgctctatgttaataagtctcccaactactgtgtagaagataagaaactgggaatcccagggacacaaggcagagaatgcaaccgtacatcagagggtgcagatggctgcaacctcctctgctgtggccgaggttacaacacccatgtggtcaggcacgtggagaggtgtgagtgtaagttcatctggtgctgctatgtccgttgcaggaggtgtgaaagcatgactgatgtccacacttgcaagtaaccactccatccagccttgggcaagatgcctcagcaatatacaatggcattgcaaccagagaggtgcccatccctgtgcagcgctagtaaagttgactcttgcagtggaatccc

SEQ ID NO: 668 - DNA, 4647 bp, Homo sapiens
gagagagagcgccgccgccatcttagttgctgccgctgccttcagcaagacgctgctctgaggcggggagggcgccgcgtcctgagcgcgcggcccagcgtcacggcggcggcggcggcggctcctccttggacccccggagctccccgcgccgcggagcagctagccccaggcccctagagccccgagagctccgagagctccgctcggcgtcccgcgcgcctccctgccgctcccgccccgggctggcgatgctgcgccgccccgctcccgcgctggccccggccgcccggctgctgctggccgggctgctgtgcggcggcggggtctgggccgcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaact

SEQ ID NO: 669 - DNA, 1228 bp, Homo sapiens
tctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatccggggcaaactggtgtcgctggagaagtaccgcggatcggtgtccctggtggtgaatgtggccagcgagtgcggcttcacagaccagcactaccgagccctgcagcagctgcagcgagacctgggcccccaccactttaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataaccaccgcgtctcctcctccaccacctcatcccgcccacctgtgtggggctgaccaatgcaaactcaaatggtgcttcaaagggagagacccactgactctccttcctttactcttatgccattggtcccatcattcttgtgggggaaaaattctagtattttgattatttgaatcttacagcaacaaataggaactcctggccaatgagagctcttgaccagtgaatcaccagccgatacgaacgtcttgccaacaaaaatgtgtggcaaatagaagtatatcaagcaataatctcccacccaaggcttctgtaaactgggaccaatgattacctcatagggctgttgtgaggattaggatgaaatacctgtgaaagtgcctaggcagtgccagccaaataggaggcattcaatgaacattttttgcatataaaccaaaaaataacttgttatcaataaaaacttgcatccaacatgaatttccagccgatgataatccaggccaaaggtttagttgttgttatttcctctgtattattttcttcattacaaaagaaatgcaagttcattgtaacaatccaaacaatacctcacgatataaaataaaaatgaaagtatcctcctca

SEQ ID NO: 670 - DNA, 1027 bp, Homo sapiens
aggactttctgtgtcctgggattcctcaggatgtggggctttttagtgttaaaagccagatggttggtcacaccagtgaggaccctggcaacggaggcaggccagaaaccatccctcagagggctgctggatgtaggcaatatccagcacagggcagcccgcgctcggggtttaacacgtggggtgatccgggtgtcacctcaggaacggagccaacaaaaccagagtgccccaaaaggccctaccccctcaaccaggccaaagcctcgcactttagggccccaggcccactctctggctctacagtctgtagacctccttttcagaccctgagctcctggaggggcaaggctgaacaggttcacctgaggcctgcatggaggaggaagggaaggaactagaatggaagggttgcctgtggaggggaagcagatcaggccccgacctcgggcaacgccccctgggtgaggagacaggctgcagctgactaaccaagtcccatccagtgggtgcaggggacacaggaggaagtggggcaagcagtaatcagaaatggggaaatgtgagctgcaacatcacccaagggctgcaactctgagaggcaaagaagctgccaggtattgggagttccagagctcctggcagcagcacaggcaggcgggtcccccagcgagccctgtccccttgctgctggctccaccctcaactccatagccccagaaacagacccaggaggagagggattgcccgggccacagccagtttgctgggcagagaccaggccagaccccacctacagcatggcgcttcccccaccagcacggcaggaggtggcaagtcccagcagcacagcgggcaccctggctctaaccagagggtgggcatcgtcccaccccttcctctcccaccccctgccgcccatgaaatgggaactgagttgcccaagagttaatcacttttctgacggtttattttattcatctttggtaacaaatggctgaaatcaattaaacttgctttcccctca

SEQ ID NO: 671 - DNA, 3558 bp, Homo sapiens
agcggggagcaagagaatttgaaaagagacatccgctccctctcacacgctgagggggaggcattcgcgtttccccaaatgagaaagaaccacaagaaatcatgaagtaaaaactttggaaagctgccactggagatgttgcacaaaaacctggaatcttttaggagtctcctcccagtcgttgaaggtttggggagcagctgatacagcaaggagggctcttgcaaggattcaagctccgagccctggaggagcagcacggagcgggagagcgtggcgagagaatgaagaaaccaatcgcccgggagaagcatgaggtggcagtgtggcactcggtttagagggcttcggccggcggtggccccatggacagccctgctggcactgggcctgcctggctgggtgttggctgtctcagccacggcggctgctgtggtccccgagcagcatgcctccgtagctggccagcatcccctggactggctgctcacagaccggggccccttccaccgcgctcaggagtatgctgacttcatggagcggtaccgccagggtttcaccaccaggtacaggatttatagggagtttgcccgttggaaggtgaacaacttggctctggaaaggaaggacttcttcagtttgccattgcctcttgccccagagtttatccggaacattcgcctccttggaaggagacccaatctgcaacaggttacagaaaatctgattaaaaagtacggcactcatttcttactttctgccacccttggaggagaagagtccctgaccatttttgtggacaagcagaaactgggaagaaagacagagacaacaggaggtgcctctataatcgggggcagtgggaacagcacagctgtgtccctggagaccctgcaccagctggccgcctcctacttcatcgacagagagagcacgctgcgacggctgcaccatatccagatagccacgggggccatcaaggtcaccgagaccaggaccggtcctctgggctgcagcaactatgacaatctggactcagtcagttctgtcttggtacagagtccagagaacaaagtacagttacttggccttcaggtgctgctgcctgagtatctgcgtgagcgctttgtagctgcagcactcagctacatcacatgcagctctgagggtgagctcgtctgcaaggagaatgactgctggtgcaagtgcagccccaccttccctgaatgcaactgccctgatgctgacatccaggccatggaggacagcctgctgcagatccaggactcctgggccactcacaaccggcagtttgaagagtcagaagagttccaggccctgctgaaaaggctgcccgatgaccggttcctgaactccacagctatctcccagttctgggccatggacaccagccttcagcaccgctaccagcagctgggagctggcttgaaagtgctgttcaaaaagacccatcggatcctacgccggctcttcaacctctgcaagcgctgccatcgccagcctcgcttccgcctgcccaaggagaggtccttgtcctactggtggaaccgaatccagtccctcctctactgtggggaaagcacctttcctggcactttcctggaacagagccacagctgcacctgcccctatgaccaatcttcctgccagggccccatcccatgtgccttgggcgaagggcccgcgtgtgcccactgtgctccagacaatagcacacgctgtgggagctgcaacccgggctatgtgctggcccaggggctgtgccggccagaggtggccgagtccctggaaaactttcttgggctggagacagacttgcaggacctggagctaaagtacctgctgcagaagcaggatagccgcattgaggtacactccatcttcatcagcaatgacatgcggctgggcagctggtttgacccttcctggaggaagcgcatgctgctcaccctgaagagcaacaagtacaagcctgggctggtgcacgtgatgttggccttgtccttgcagatctgtctcaccaagaacagcaccctggagcctgtcatggccatctacgtcaacccctttgggggcagccactctgagagctggttcatgcctgtgaatgagggcagctttcctgactgggaaaggactaacgtggatgcagctgcccagtgccaaaactggactatcaccttggggaataggtggaagactttctttgagacagttcatgtttacctacggagccgaatcaagtccctggatgacagctccaatgagacaatctactatgagcccctggagatgactgatccctctaagaatttgggttacatgaaaattaacaccttgcaggtctttggctacagcctgccctttgacccagatgctatccgggacttaattctccagttggactacccatatactcaaggttcccaggactctgcactcttgcagctcattgagctcagggaccgggtgaaccagctttctccacctggcaaagtccgacttgaccttttctcctgcttgctccggcatcggcttaagctggccaacaatgaggtgggcaggatccagtcctccctgagggctttcaattctaagctgccaaaccctgtggaatatgagaccggcaaactctgtagctaatgggcggcccacttcagcactgggcaaggaggggatccatgaatctggggtacaaagataatctaagccctcaccttagtgccaacagggtgtgctcccacgagactttcagcatccagtagatgggacctcgaggctcgagctgaagcaggcgagagagaaacagctactgcgtgcgtgcgcgcacgcatacacacacacacacacacactggcacagggaggctacaactaagcagcctcagatctgtaaagttgattggtgctttctaaaatgaatgcaattgaaagaaaggagccaaggaagagattaagaaaaagaaccagctgaaccatgaaacaaacaaaaatcctaaaagtgattcttgtcattcaagaaagcaagaggggacaacaatgggaggggtcggagctcttccttcccctctgtggagtcacttttgtattctttttaaccagatttcttaaaatgttgttgttttgtgaatcctgacattggttcttacttttgtatgctgcctcctctgtgccctcccagacgctgactgggaaacacaagaagtacaaccaacaggaaccagcgccaagggcaggcagcggcctccttgctcccctcccttactcctccctctgctgcctcctccccccaccaagtttcagggccctggattgttcccagttcccattgtggtcccttcagagctcctttccaacagcatctctctgtcgaagaaagaagctctgtcaagttagagagagacaatgtgtaggaaatgttcttttttaaaaaaaaataacaaaaacaaaacaaaactatttattttgtgattgttttccttgttaatctgctccaaccacctgaacatctaagtaaacatttatctggtttaatata

SEQ ID NO: 672 - DNA, 2563 bp, Homo sapiens
gcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaaccaa

SEQ ID NO: 673 - DNA, 551 bp, Homo sapiens
ccaagaaggaagccgtctatcttgtggcgatcatgtataagctggcctcctgctgtttgcttttcataggattcttaaatcctctcttatctcttcctctccttgactccagggaaatatcctttcaactctcagcacctcatgaagacgcgcgcttaactccggaggagctagaaagagcttcccttctacagatactgccagagatgctgggtgcagaaagaggggatattctcaggaaagcagactcaagtaccaacatttttaacccaagaggaaatttgagaaagtttcaggatttctctggacaagatcctaacattttactgagtcatcttttggccagaatctggaaaccatacaagaaacgtgagactcctgattgcttctggaaatactgtgtctgaagtgaaataagcatctgttagtcagctcagaaacacccatcttagaatatgaaaaataacacaatgcttgatttgaaaacagtgtggagaaaaactaggcaaactacaccctgttcattgttacctggaaaataaatcctctat

SEQ ID NO: 674 - DNA, 1593 bp, Homo sapiens
tctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatttttggggggagagacacagatttttacactaatatatggacctagcttgaggcaattttaatcccctgcactaggcaggtaataataaaggttgagttttccac

SEQ ID NO: 675 - DNA, 2274 bp, Homo sapiens
tcagcccacttccggggagggaggcagaggaacccctccccgccgctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatc

SEQ ID NO: 676 - DNA, 1056 bp, Homo sapiens
gtggagtgagtctgaggacagcagatgaacagacagaaactgaaagatccccaaaaaggatgagtgagagggtcgagcggaactggagcacgggcggctggctgctggcactgtgcctggcctggctgtggacccacctgaccttggctgccttgcagcctcccactgccacagtgcttgtgcagcagggcacctgcgaggtgattgcggctcaccgctgctgcaaccggaaccgcatcgaggagcgctcccagacggtgaaatgctcctgtttttctggccaggtggccggcaccacgcgggcaaagccctcctgcgtggacgcctccatcgtcctgcagagatggtggtgtcagatggagccctgcctgccgggggaggagtgtaaggtgctcccggacctgtcgggatggagctgcagcagtggacacaaagtcaaaaccaccaaggtcacacgatagctcttgggggtcacggcctggacaagaaaggcttgactgagccgtgaactgaagaatggtatccagtcatcagccaggaaagatggggattcacttacatgcctcatgtcaaatgcagcatcagtctttccggggcatttcagttaagctgctcagcagatatggatggatctgcaatcacatacctaatgtggagctgggcttttctggagacacgaaggtcaacacacaattcctgcccttaaggaatgtccagttgaattggagagttgatgacagacaatttagataatttaggttaaagtacttgataccagactgcggcttctgggccacatgctatggcatgatgggggtttgggaatgagattcccacagttcttcagataccctgtggccacagggcatagaaacaagaggtcacattcagcacccaccacctccctctttcgcatcagttctgaatccccagcaagctgttaacatgttgcaggaaaacactctccccttatgccagaccagcagtatctcatttggatgggattggattgacttgcggaaggaaagtaaaaataaagccaaataacttcccaaa

SEQ ID NO: 677 - DNA, 4246 bp, Homo sapiens
ccgcgactccgctccaggcaggacccccaacccgcccagcccgctccgccttgcgccccggacccgcggccgaccccagacccgctgcccgcttcgcgcccgaggcctgcgccccgacggacgcccgtgcccagcttgccacgcccacgcccggcgccccgaccgcggaggactccccgaggtgccggcggagggggtggctcgcggctcaggctgcccccgacgtgcccggctcaccgccccctcccctgcagccccgcccgccatggcccggatcccgacggccgccctgggttgcatcagcctcctctgcctgcagctccctggctcgctgtcccgcagcctgggcggggacccgcgacccgtcaaacccagggagcccccagcccggagcccttccagcagcctgcagcccaggcaccccgcaccccgacctgtggtctggaagcttcaccgggccctccaggcacagaggggtgccggcctggcccctgttatgggtcagcctctccgggatggtggccgccaacactcgggcccccgaagacactcgggcccccgcaggacccaagcccagctcctgcgagtgggctgtgtgctgggcacctgccaggtgcagaatctcagccaccgcctgtggcaactcatgggaccggccggccggcaggactcagctcctgtggaccccagcagcccccacagctatggctgaggtggggccgggccacacccctgcccatcccagccagggtgctgtgcccccgtccagagctgcagctgagccccatctgaagcccagtccctcggagctgcagacagcaggtcctgcagcaacaatacctgcacggctttgcacacgtaaacctaggctggtctacacgcagtgctggtacgtcaaggagcctaaacaccctgaaattgtgaccccctgggggacagctgccagacacagctggcggcagcaccagatgctaagcgcttcagagaggaggtgtctgcccagagatgtggagcagaagctgggccctgaacacacggggccatgtctggacgagcaggggagagaggctgaactggccagaagtggcccctccgctgctggtccagtcagactgaagcccggccttgtgcctgggctgttcctgctctcatgcacaaccagcccttccacgtgcctgcctgtgggacaggagggggagcgtgggatgctgtagcccccggggttgggcaagggaaggatggtggccctccagaggtcatgaagggacctctgtggctccagctgccaaccctggagcccagaccgaggtggccatggagactccacctggatcccctgtaggaggccagggaggggaactcagcagttcaggagccaccccaaaccattctgggacagggacacccctttctaccccagggcagggcagggctgggtggggcaagatcccccagcccgactagacccacctcacctgaagggggtgagacccttgttggcagccagacaagggtggggctccacaggcagcacaggcgccccaccaccacccagtttggggacccagtgggaccaggtgcgggggcagagggtgacttaccaagagccagggagggcagcccaggcccaagtgacagcaagaacaagaaccactgccggcgtgcacagacttggtgtgtgtccttccctggggggacgggggactcacatgtgcctgccactggagcctctcaaccgtccagcagaacacggggttcagaaagggctccttctgctatttagcgaacactgagcatttaatttacaaatgtttgctagggtcaccctctcggccatcccacgagggtcgccatgatcaccccaactctagaggccgcagcagagctcaggacattcccccacagagcttgcccctcagttcctacctccaagggggagggtcctggaagcgcccacccaggcgccgcccctgtgcttgctccccgagctcagggattgccgagtccacgtaactgacctgtactccacgaggccctgtgggaacggtccaggctggtcctgccctgtggaggcctccgtgcactgagagatgtactaggattgcagcaaaggtggtcagggtgatgggccgcacagcgaggcagtcaaggccagctccctgggagaagcactgggtcaggtgaggtctgaggacagcaggccttccctaggggaaggagctgggagtgccaaggccccaggtgcacaggaggcgtggctgctgagaggctgcagggtggaggggcctcggcctcagagtcatgtgccctgtgaccactgaagggtgtcagcagagcacacggcatgaggacagagggaggggcacggggagtgaaggagggggccctggggcaaggctcgggggtcaggagctcagcgtccgctactcagcccagccaaaaccctcccagacgtctcctctcctgcctgggcaaagtccagcttggcaccccgtctggggcctgcctgtggtcagggccaagtgttccctcctccaggaaagcctttaccctcctcatgccctgtagtcaggaggccgcctgctgtaaccctccgtgtcgcctcgggtgcgaaatcagacccacctgacaccatcacgcggaggcccagcagcacctgcacccacttccagctgctctggccaaaatctccgctcggccaggccccgtggctcacacctgtaatcctagcacattgggaggccaaggcaggcacatcacctgagttcaggagttcaagaccagcctggccaacatggtgaaatcccgtctctactaaaaacagaaaattatccgggcgtggtggcacatgactgtaatcccagctactcaggaggctgaggcaggaggatcacttgaacctgggaggcggaggttgcagtgagctgagattgcgccattgcactccagcctgggcaacaagagcaaaattctgcctcaaaaaaaaaaatagtaataatacaaaaattagctgggcgtggtggcacatgccagtaattccatctactcgggaggctgaggcaggagaatcgtctaagcccgggaggtggaggttgcagtgagcccagatggcgctgctgcactcaagcttggatgacagagcaagactccgtttcaaaaaaaaaaaacctcctctcttccttcacaccttcctctgaatcccacccggtcccacctcctgaacctatccagacaccttctcctgacccaggcaccacctgctttcggggcgatggccgtagcctcctcccaggcacctgtctgcatccctctggccagtgcatgctgagcacgtgacctacccgtgttgggacacgtgaggatacagccttgacccccaggggctgacattctagggggagatagaaggagacaaacgtagaaggtagaataagtgggtggtggagtggcagggagtgctgagtgccacaggaagtcagacaaggaaggagagtgtggggcaggtgccgtttaaatggggggcgctggggtctcctcacagttgcttctcagctcagctgtgccaggatcttgttgagtcaggtcagctgcccacagccctcttgcctgacccctgaagcccagaactctgatcttcacagccctaggtatggccccagcaccccactgccctctctcctgccccagccgactgctgttcccagacttccctggccacgctccaagacgccagctctgccgcgggcactttgttctcacggtgtcctccatgcctgcagggcccatgcatgggaagttgcgttggcggcctgggtgttggcggttccgtgcctgctccaactctccgtgaggcccctctcccagagcctgacacactctgtggccgaactctaggcaggtgcccctgagtcctttcctcgacgaggcctgaccccatccccatcctcgctgggcccgccgaccccggtgttagcaagaatcctctaaatcagtttatggagaattacccaccctcgatatctgatcccattcctcatctcccacccttgatctcatcaccctgccggcctcctgcaagatcctcattgagccactccagtgagaatccccctaccctcgaaggccgccctaacaacttcccatccgctgacccctccaacgccatcaatctccagctgtggttgttgaactcggaggtgagctcctctcaccactctcttgaataaagcttttctcaccattttaa

SEQ ID NO: 678 - DNA, 1874 bp, Homo sapiens
gctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggcggcggcggcggcggcggaggaggcgaccgagaagatacccgccctgcgccccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaa

SEQ ID NO: 679 - DNA, 412 bp, Homo sapiens
gcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccacata

SEQ ID NO: 680 - DNA, 1176 bp, Homo sapiens
ccctactggtccttctgccttagccacaggttctgaaaccaaagcaaaaccaccagagagtgattcatgtggagacaggataacccaataaaatcgccccttaggtggggtgtgttggctcacacctgtagcctgtaatcccagcactttggaaggctgaggcaggtggatcacctgaggtcagcagtttgagaccagcctgaccaacaagttgaagccccatgtctactaaaaatagaaaaattagcagggcgtggtggtaggtgcctgtagtcccagctacttgggaggctgagacaggagaattacttgaacctgggaggcagaggttgcaatgagctgagatcatgccactgcactccagcctggacgacagagcgagactctgtataaaacaaaaacaacaacaacgaaaaattaccccttaatggtggttggttggtcagacagccagcttgaattgctgtctttttcccaaacccagattccctggctgaggcaccagttaaaacttttatcttagggaagctctgggagttgcctcttgcaggtcaggggttccaaagggcagaagctccagcataccatcttcttgagcatttccggttcagatttctatgggattaatggctcctgcaccttctacctcccagggaggctccctgagctctgctttatataagattttcaggttctgaacacaagcccagtttctgcttctgatgatcattttcaatagagcataaaaaacagagccatgttccacgtttttacggcctctgcacttggcaaaatattcttcccgaatggcctcacgtgtgctccctatcatcacgccttttcagctaggcaacgctcagagtcacacctgagtggaggccgacgcccctttggaggcgactccagccataaaaagtcctgcttggagctggttttagccacagagggccaataaatggccccttctgaatgaggtgcccctgcacctctgcagagcctgctgccagcctccaggatctaactgggctctgattcaccgctcccaaccccacatccagtcccgtggagtctccatctgagccctttcctagtccaggcatcccgatgttggtggatggcccatctgagcggccagccctgtgcttcttgctgttggctgtggcaatgtctttcttc

SEQ ID NO: 681 - DNA, 5412 bp, Homo sapiens
accgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcagttgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctatgctctcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacttggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacagaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaa

SEQ ID NO: 682 - DNA, 3174 bp, Homo sapiens
aaaccaggaagccggcgaccctcacctcctcgggggctgggaggaaggaggaaaacgaaagtcgccgccgccgcgctgtcccccgagagctgcctttcctcgggcatccctggggctgccgcgggacctcgcagggcggatataaagaaccgcggccttgggaagaggcggagaccggcttttaaagaaagaagtcctgggtcctgcggtctggggcgaggcaagggcgcttttctgcccacgctccccgtggcccatcgatcccccgcgcgtccgccgctgttctaaggagagaagtgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaactgctgccgcgggggcgcggggccaccgccgtgcgcctgccggaccttcttccgcgtgtgcctcaagcactaccaggccagcgtgtcccccgagccgccctgcacctacggcagcgccgtcacccccgtgctgggcgtcgactccttcagtctgcccgacggcgggggcgccgactccgcgttcagcaaccccatccgcttccccttcggcttcacctggccgggcaccttctctctgattattgaagctctccacacagattctcctgatgacctcgcaacagaaaacccagaaagactcatcagccgcctggccacccagaggcacctgacggtgggcgaggagtggtcccaggacctgcacagcagcggccgcacggacctcaagtactcctaccgcttcgtgtgtgacgaacactactacggagagggctgctccgttttctgccgtccccgggacgatgccttcggccacttcacctgtggggagcgtggggagaaagtgtgcaaccctggctggaaagggccctactgcacagagccgatctgcctgcctggatgtgatgagcagcatggattttgtgacaaaccaggggaatgcaagtgcagagtgggctggcagggccggtactgtgacgagtgtatccgctatccaggctgtctccatggcacctgccagcagccctggcagtgcaactgccaggaaggctgggggggccttttctgcaaccaggacctgaactactgcacacaccataagccctgcaagaatggagccacctgcaccaacacgggccaggggagctacacttgctcttgccggcctgggtacacaggtgccacctgcgagctggggattgacgagtgtgaccccagcccttgtaagaacggagggagctgcacggatctcgagaacagctactcctgtacctgcccacccggcttctacggcaaaatctgtgaattgagtgccatgacctgtgcggacggcccttgctttaacgggggtcggtgctcagacagccccgatggagggtacagctgccgctgccccgtgggctactccggcttcaactgtgagaagaaaattgactactgcagctcttcaccctgttctaatggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacagcgccgacaagaatggcttcaaggcccgctacccagcggtggactataacctcgtgcaggacctcaagggtgacgacaccgccgtcagggacgcgcacagcaagcgtgacaccaagtgccagccccagggctcctcaggggaggagaaggggaccccgaccacactcaggggtggagaagcatctgaaagaaaaaggccggactcgggctgttcaacttcaaaagacaccaagtaccagtcggtgtacgtcatatccgaggagaaggatgagtgcgtcatagcaactgaggtgtaaaatggaagtgagatggcaagactcccgtttctcttaaaataagtaaaattccaaggatatatgccccaacgaatgctgctgaagaggagggaggcctcgtggactgctgctgagaaaccgagttcagaccgagcaggttctcctcctgaggtcctcgacgcctgccgacagcctgtcgcggcccggccgcctgcggcactgccttccgtgacgtcgccgttgcactatggacagttgctcttaagagaatatatatttaaatgggtgaactgaattacgcataagaagcatgcactgcctgagtgtatattttggattcttatgagccagtcttttcttgaattagaaacacaaacactgcctttattgtcctttttgatacgaagatgtgctttttctagatggaaaagatgtgtgttattttttggatttgtaaaaatatttttcatgatatctgtaaagcttgagtattttgtgatgttcgttttttataatttaaattttggtaaatatgtacaaaggcacttcgggtctatgtgactatatttttttgtatataaatgtatttatggaatattgtgcaaatgttatttgagttttttactgttttgttaatgaagaaattcctttttaaaatatttttccaaaataaattttatgaatgacaa

SEQ ID NO: 683 - DNA, 1267 bp, Homo sapiens
gctgggggcgctgcctcgagcctcatggctgcccctgcttccgtcatgggcccactcgggccctctgccctgggccttctgctgctgctcctggtggtggcccctccccgggtcgcagcattggtccacagacagccagagaaccagggaatctccctaactggcagcgtggcctgtggtcggcccagcatggaggggaaaatcctgggcggcgtccctgcgcccgagaggaagtggccgtggcaggtcagcgtgcactacgcaggcctccacgtctgcggcggctccatcctcaatgagtactgggtgctgtcagctgcgcactgctttcacagggacaagaatatcaaaatctatgacatgtacgtaggcctcgtaaacctcagggtggccggcaaccacacccagtggtatgaggtgaacagggtgatcctgcaccccacatatgagatgtaccaccccatcggaggtgacgtggccctggtgcagctgaagacccgcattgtgttttctgagtccgtgctcccggtttgccttgcaactccagaagtgaaccttaccagtgccaattgctgggctacgggatggggactagtctcaaaacaaggtgagacctcagacgagctgcaggagatgcagctcccgctgatcctggagccctggtgccacctgctctacggacacatgtcctacatcatgcccgacatgctgtgtgctggggacatcctgaatgctaagaccgtgtgtgagggcgactccgggggcccacttgtctgtgaattcaaccgcagctggttgcagattggaattgtgagctggggccgaggctgctccaaccctctgtaccctggagtgtatgccagtgtttcctatttctcaaaatggatatgtgataacatagaaatcacgcccactcctgctcagccagcccctgctctctctccagctctggggcccactctcagcgtcctaatggccatgctggctggctggtcagtgctgtgaggtcaggatacccactctaggattctcatggctgcacaccctgccccagcccagctgcctccagacccctaagcatctcctgtcctggcctctctgaagcagacaagggccacctatcccgggggtggatgctgagtccaggaggtgatgagcaagtgtacaaaagaaaaaagggaagggggagaggggctggtcagggagaacccagcttgggcagagtgcacctgagatttgataagatcattaaatatttacaaagcaa

SEQ ID NO: 684 - DNA, 1907 bp, Homo sapiens
gtcacgagccgccagccgccgggtggagggtcccggccgggagccgcggaaagagtagggctccccagacaacggggtccgacgagcagttgggcacgggctgagtccgcctgccggcagaatgtccctggctgcttattgcgtcatctgttgcagaagaataggaacctctacttccccaccaaaaagtggcacacactggagagatatcagaaatataataaagtttactggatcacttattttaggaggttctttatttcttacatatgaagttctggccctgaagaaggctgtgacattagatactcaagtggtagaacgagaaaaaatgaagtcatatatatatgtgcacacagtttctttagacaaaggagaaaatcatggtattgcctggcaggcaagaaaagaacttcacaaagcagtaagaaaagtattggcaacatcagccaagatactgcggaatccatttgctgatccttttagtacagttgatatagaagatcatgagtgtgctgtgtggctgctcctacggaagagcaagtcagatgacaaaaccacgcgactcgaggctgtgcgggaaatgtcggagacccatcactggcatgattaccagtataggataattgctcaagcctgtgatccgaaaactcttattggtttggcacgaagcgaagagagtgatcttcgcttttttctcctaccacctcctttgccatctttaaaagaagattcttccactgaagaagagctcagacagttgctggcttccttacctcaaacagagctagatgagtgtatccagtattttacatctttggctcttagtgaaagcagtcagagtctagctgctcagaagggtggtttatggtgttttggaggaaatggacttccttatgctgaaagttttggagaagttccttcagcaacagtggaaatgttctgtttagaagctatagtaaaacattctgagatatccacacattgtgataaaatcgaagcaaatggaggcctgcagctacttcagaggctgtaccgacttcacaaggactgccctaaagtacagagaaatataatgcgtgtcattggaaatatggctttgaatgaacatcttcattcttctatagttcgctcaggctgggtttccatcatggcagaagcaatgaaatctccccacattatggagtcctcacacgctgccagaatcctggcaaatctagaccgagaaactgtgcaagaaaaatatcaggatggcgtatatgtgctgcatccccaatatcgaacaagtcagcccattaaagcagatgtcctttttattcatggccttatgggagcagcattcaaaacatggcgccagcaggacagtgagcaggctgtaattgaaaaacctatggaggatgaagacagatatacgacgtgctggcccaagacatggttagcaaaagactgtcctgctctccgaattatatctgtggagtatgacaccagcctcagcgactggagagcaaggtgccctatggaaagaaggagtttgctgtcaataagcagtggaatagtagaaggcttagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaagggtaatactttttgtcataaaggaaattggggttatattaacatcagttacacagagaa

SEQ ID NO: 685 - DNA, 4013 bp, Homo sapiens
agagcgggccgagggggcggggtcacgagccgccagccgccgggtggagggtcccggccgggagccgcggaaagagtagggctccccagacaacggggtccgacgagcagttgggcacgggctgagtccgcctgccggcagaatgtccctggctgcttattgcgtcatctgttgcagaagaataggaacctctacttccccaccaaaaagtggcacacactggagagatatcagaaatataataaagtttactggatcacttattttaggaggttctttatttcttacatatgaagttctggccctgaagaaggctgtgacattagatactcaagtggtagaacgagaaaaaatgaagtcatatatatatgtgcacacagtttctttagacaaaggagaaaatcatggtattgcctggcaggcaagaaaagaacttcacaaagcagtaagaaaagtattggcaacatcagccaagatactgcggaatccatttgctgatccttttagtacagttgatatagaagatcatgagtgtgctgtgtggctgctcctacggaagagcaagtcagatgacaaaaccacgcgactcgaggctgtgcgggaaatgtcggagacccatcactggcatgattaccagtataggataattgctcaagcctgtgatccgaaaactcttattggtttggcacgaagcgaagagagtgatcttcgcttttttctcctaccacctcctttgccatctttaaaagaagattcttccactgaagaagagctcagacagttgctggcttccttacctcaaacagagctagatgagtgtatccagtattttacatctttggctcttagtgaaagcagtcagagtctagctgctcagaagggtggtttatggtgttttggaggaaatggacttccttatgctgaaagttttggagaagttccttcagcaacagtggaaatgttctgtttagaagctatagtaaaacattctgagatatccacacattgtgataaaatcgaagcaaatggaggcctgcagctacttcagaggctgtaccgacttcacaaggactgccctaaagtacagagaaatataatgcgtgtcattggaaatatggctttgaatgaacatcttcattcttctatagttcgctcaggctgggtttccatcatggcagaagcaatgaaatctccccacattatggagtcctcacacgctgccagaatcctggcaaatctagaccgagaaactgtgcaagaaaaatatcaggatggcgtatatgtgctgcatccccaatatcgaacaagtcagcccattaaagcagatgtcctttttattcatggccttatgggagcagcattcaaaacatggcgccagcaggacagtgagcaggctgtaattgaaaaacctatggaggatgaagacagatatacgacgtgctggcccaagacatggttagcaaaagactgtcctgctctccgaattatatctgtggagtatgacaccagcctcagcgactggagagcaaggtgccctatggaaagaaggagtttgctgtcaataagcagtggaatagtagaaggcttagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaaggattctcctgcacttaaaacactacaagatgactttctggagtttgctaaagacaaaaacttccaggtgctgaattttgtggaaacactaccaacctacattggcagcatgattaagctccatgtggtacctgtggaatcagcagatttaggcattggagatctaattcctgtggatgttaaccatttgaacatttgtaagccaaagaaaaaggatgcttttttgtaccagcgtactttacaattcattcgtgaagctttagccaaagaccttgaaaactaacagttgtgctcttccagttttcatatgtgaattcagtgcaagaaacttggtgttctgtttcttcttttaagctctatgcaatcatgcaaacatagtgatcatagcgtcaacatggtctggagtgtgttgcagactacagaacattgttctcccttcaagcgctgtaaagcaccaacccggaagtggcaggcacagaaggaagggctggattgggcccctttggtgtaaagaagtccctgtgtgctgctttatggttcgcagtgttgggcttggtgactggagcaaagctgctgtgagagagtgtcctttcccatctgtgactttcctggtgcatccaggaggggcacggcaggttctgaggtaactcaacttaccataaaaatgccattaagagagtacctaaaatggagagaagaatgaactagaacattcaagactcttttacttctgggtattgatttgctgtacatttttaaagtttgagtttttagctcagttctaccttttatctgacacattattactagtgttaactttgttagacttattgtcatgtctgggtcagttccttgtatctattttcgtattcctgagaacaaatctttttcttagaaaaattctagcttataataattcttttcagactgtagctgcctatgcttggaatttgtcctagataaggataaagtagctaatccattattgatcacagtatgaagtaaaactattctaagccattatatgaattagcaattcttagtatcaagattctcagattctctttggctaaataaacctttcttcttccttgctcatttgcaagtggtattaattgacctctatagcatgtgagtagtagataatcatgtcgatgacctttttttctttagagtaacagcattattgagatataatttacataccataagattcacccttttaaattatacaattcatttttgttttgttttgtttgtttagagacagggtctgactctgttgcccaagctggagtgcagtggcatgatcatagctcattgtaacctcaaactcctgggctcaagagatccttttgcttcagcctcccaagcagctaggactacaggcacatgccaccacacttgggtaattaaaaaataaataaatacttttttgtagagacagggtctcactgtgttgcccaggtctcaaactcccgatctcaagccaccctcccaaaatgctgtgattataggccagagccattgttcccaggctcaattcattggtttttagtatagttcactgagttgtgcaacatcattgctatttaatttcaggctatttcatcatccccaaaagaaccccatacccatgagcagtcagttcccacctctgctttcccaagcctgcggtaaacactaatctgttttctgtctctatggatttgggaattttatgtaaatggaatcatacaatatgtggccctctctgccttcttccttctattagcatgttttcaaggttcattcatgatatagcatgtatcagtactacttcatttctttttatggccgaaattactccattgtatgatatgccatgtttctttatccattcatcagctgatggacatctaggttctgttcatttttgtctatgataaataatgctaccatgatcatttgtgtacaaatttatgtgtggatagatgtttttgattctcttgggtggaattgctggtcaaatggtaagtctatgtttaaattttgaagatggtgaacttttgtagaatgagatagtcgaagctaaaactggagtatggcatctgaaggtaaatggctcatcaataaactcgatatcaacaattaattgtttcattg

SEQ ID NO: 686 - DNA, 3948 bp, Homo sapiens
gagggggcggggtcacgagccgccagccgccgggtggagggtcccggccgggagccgcggaaagagtagggctccccagacaacggggtccgacgagcagttgggcacgggctgagtccgcctgccggcagaatgtccctggctgcttattgcgtcatctgttgcagaagaataggaacctctacttccccaccaaaaagtggcacacactggagagatatcagaaatataataaagtttactggatcacttattttaggaggttctttatttcttacatatgaagttctggccctgaagaaggctgtgacattagatactcaagtggtagaacgagaaaaaatgaagtcatatatatatgtgcacacagtttctttagacaaaggagaaaatcatggtattgcctggcaggcaagaaaagaacttcacaaagcagtaagaaaagtattggcaacatcagccaagatactgcggaatccatttgctgatccttttagtacagttgatatagaagatcatgagtgtgctgtgtggctgctcctacggaagagcaagtcagatgacaaaaccacgcgactcgaggctgtgcgggaaatgtcggagacccatcactggcatgattaccagtataggataattgctcaagcctgtgatccgaaaactcttattggtttggcacgaagcgaagagagtgatcttcgcttttttctcctaccacctcctttgccatctttaaaagaagattcttccactgaagaagagctcagacagttgctggcttccttacctcaaacagagctagatgagtgtatccagtattttacatctttggctcttagtgaaagcagtcagagtctagctgctcagaagggtggtttatggtgttttggaggaaatggacttccttatgctgaaagttttggagaagttccttcagcaacagtggaaatgttctgtttagaagctatagtaaaacattctgagatatccacacattgtgataaaatcgaagcaaatggaggcctgcagctacttcagaggctgtaccgacttcacaaggactgccctaaagtacagagaaatataatgcgtgtcattggaaatatggctttgaatgaacatcttcattcttctatagttcgctcaggctgggtttccatcatggcagaagcaatgaaatctccccacattatggagtcctcacacgctgccagaatcctggcaaatctagaccgagaaactgtgcaagaaaaatatcaggatggcgtatatgtgctgcatccccaatatcgaacaagtcagcccattaaagcagatgtcctttttattcatggccttatgggagcagcattcaaaacatggcgccagcaggacagtgagcaggctgtaattgaaaaacctatggaggatgaagacagatatacgacgtgctggcccaagacatggttagcaaaagactgtcctgctctccgaattatatctgtggagtatgacaccagcctcagcgactggagagcaaggtgccctatggaaagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaaggattctcctgcacttaaaacactacaagatgactttctggagtttgctaaagacaaaaacttccaggtgctgaattttgtggaaacactaccaacctacattggcagcatgattaagctccatgtggtacctgtggaatcagcagatttaggcattggagatctaattcctgtggatgttaaccatttgaacatttgtaagccaaagaaaaaggatgcttttttgtaccagcgtactttacaattcattcgtgaagctttagccaaagaccttgaaaactaacagttgtgctcttccagttttcatatgtgaattcagtgcaagaaacttggtgttctgtttcttcttttaagctctatgcaatcatgcaaacatagtgatcatagcgtcaacatggtctggagtgtgttgcagactacagaacattgttctcccttcaagcgctgtaaagcaccaacccggaagtggcaggcacagaaggaagggctggattgggcccctttggtgtaaagaagtccctgtgtgctgctttatggttcgcagtgttgggcttggtgactggagcaaagctgctgtgagagagtgtcctttcccatctgtgactttcctggtgcatccaggaggggcacggcaggttctgaggtaactcaacttaccataaaaatgccattaagagagtacctaaaatggagagaagaatgaactagaacattcaagactcttttacttctgggtattgatttgctgtacatttttaaagtttgagtttttagctcagttctaccttttatctgacacattattactagtgttaactttgttagacttattgtcatgtctgggtcagttccttgtatctattttcgtattcctgagaacaaatctttttcttagaaaaattctagcttataataattcttttcagactgtagctgcctatgcttggaatttgtcctagataaggataaagtagctaatccattattgatcacagtatgaagtaaaactattctaagccattatatgaattagcaattcttagtatcaagattctcagattctctttggctaaataaacctttcttcttccttgctcatttgcaagtggtattaattgacctctatagcatgtgagtagtagataatcatgtcgatgacctttttttctttagagtaacagcattattgagatataatttacataccataagattcacccttttaaattatacaattcatttttgttttgttttgtttgtttagagacagggtctgactctgttgcccaagctggagtgcagtggcatgatcatagctcattgtaacctcaaactcctgggctcaagagatccttttgcttcagcctcccaagcagctaggactacaggcacatgccaccacacttgggtaattaaaaaataaataaatacttttttgtagagacagggtctcactgtgttgcccaggtctcaaactcccgatctcaagccaccctcccaaaatgctgtgattataggccagagccattgttcccaggctcaattcattggtttttagtatagttcactgagttgtgcaacatcattgctatttaatttcaggctatttcatcatccccaaaagaaccccatacccatgagcagtcagttcccacctctgctttcccaagcctgcggtaaacactaatctgttttctgtctctatggatttgggaattttatgtaaatggaatcatacaatatgtggccctctctgccttcttccttctattagcatgttttcaaggttcattcatgatatagcatgtatcagtactacttcatttctttttatggccgaaattactccattgtatgatatgccatgtttctttatccattcatcagctgatggacatctaggttctgttcatttttgtctatgataaataatgctaccatgatcatttgtgtacaaatttatgtgtggatagatgtttttgattctcttgggtggaattgctggtcaaatggtaagtctatgtttaaattttgaagatggtgaacttttgtagaatgagatagtcgaagctaaaactggagtatggcatctgaaggtaaatggctcatcaataaactcgatatcaacaattaa

SEQ ID NO: 687 - DNA, 2152 bp, Homo sapiens
gtcagaactaccccggtagcctgacagcaggagctcgagagaagcatggctcagcggtgcgtttgcgtgctggccctggtggctatgctgctcctagttttccctaccgtctccagatcgatgggcccgaggagcggggagcatcaaagggcgtcgcgaatcccttctcagttcagcaaagaggaacgcgtcgcgatgaaagaggcgctgaaaggtgccatccagattccaacagtgacttttagctctgagaagtccaatactacagccctggctgagttcggaaaatacattcataaagtctttcctacagtggtcagcaccagctttatccagcatgaagtcgtggaagagtatagccacctgttcactatccaaggctcggaccccagcttgcagccctacctgctgatggctcactttgatgtggtgcctgcccctgaagaaggctgggaggtgcccccattctctgggttggagcgtgatggcatcatctatggtcggggcacactggacgacaagaactctgtgatggcattactgcaggccttggagctcctgctgatcaggaagtacatcccccgaagatctttcttcatttctctgggccatgatgaggagtcatcagggacaggggctcagaggatctcagccctgctacagtcaaggggcgtccagctagccttcattgtggacgaggggggcttcatcttggatgatttcattcctaacttcaagaagcccatcgccttgattgcagtctcagagaagggttccatgaacctcatgctgcaagtaaacatgacttcaggccactcttcagctcctccaaaggagacaagcattggcatccttgcagctgctgtcagccgattggagcagacaccaatgcctatcatatttggaagcgggacagtggtgactgtattgcagcaactggcaaatgagtttcccttccctgtcaatataatcctgagcaacccatggctatttgaaccacttataagcaggtttatggagagaaatcccttaaccaatgcaataatcaggaccaccacggcactcaccatattcaaagcaggggtcaagttcaatgtcatccccccagtggcccaggccacagtcaacttccggattcaccctggacagacagtccaagaggtcctagaactcacgaagaacattgtggctgataacagagtccagttccatgtgttgagtgcctttgaccccctccccgtcagcccttctgatgacaaggccttgggctaccagctgctccgccagaccgtacagtccgtcttcccggaagtcaatattactgccccagttacttctattggcaacacagacagccgattctttacaaacctcaccactggcatctacaggttctaccccatctacatacagcctgaagacttcaaacgcatccatggagtcaacgagaaaatctcagtccaagcctatgagacccaagtgaaattcatctttgagttgattcagaatgctgacacagaccaggagccagtttctcacctgcacaaactgtgaggtcaaggggcctgctgggttaggcatgcccgaccccgggacaggactaacccaagggggaaagctagtgttgatgaaacttttgatcaaaaccacattgtaaaacattgcccatctgtcttgctcactcttaaactctcccaagaacaaggccggggtaaggtaaagtcagcagaaatctggcttctcccttcctcccgacatctgcatcccttgatccactggcatttgctgccctcttgtcccttatctgtcttatgctggttatttcactgcttcaccttccaggcttgacttaacaaatgtagatttgagaaatctcaaccagttgttacctgataggagtctttaatttagggcactcttgctgggatgctttctccagagcttatatatttcttcttactagaactttcttcccccttttattcccctctcttcttggactcatgagctgtctcttcatctctcctctctctcctgcatctctccccttactcttcaatttattctacttctggacctggacttacccaaactgtgatactaccataattgtcaccataatcagtcaaataaagtgatctgtgcatcacca

SEQ ID NO: 688 - DNA, 1359 bp, Homo sapiens
gacagcctccaccagagtccccacctttctggaagctgcagggctctccatccaggatccagaagcattgaaggggaccagccgctgaagggattctcagtcccatctgactccccatgaggctcctggctttcctgagtctgctggccttggtgctgcaggagacagggacagcttctctcccaaggaaggagaggaagaggagagaggagcagatgcccagggaaggcgattcctttgaagttctgcctctgcggaatgatgtcctgaacccagacaactatggtgaagtcattgacctgagcaactatgaggagctcacagattatggggaccaactccccgaggttaaggtgactagcctcgctcctgcaaccagcatcagtcccgccaagagcactacggctccagggacaccctcgtcaaaccccacgatgaccagacctactacagcagggctgctactgagttcccagcccaaccatggtctgcccacctgcctggtctgcgtgtgcctcggttcctctgtgtattgcgatgacattgacctagaggacattcctcctcttcctcggaggactgcctacctgtatgcacgcttcaaccgcatcagccgtatcagggccgaagacttcaaagggctgacaaagttgaagaggattgacctctccaacaacctcatttcctccatcgataatgatgccttccgcctgctacatgccctccaggacctcatcctcccagagaaccagttggaagctctgcccgtgctgcccagtggcattgagttcctggatgtccgcctaaatcggctccagagctcggggatacagcctgcagccttcagggcaatggagaagctgcagttcctttacctgtcagacaacctgctggattctatcccggggcctttgcccctgagcctgcgctctgtacacctgcagaataacctgatagagaccatgcagagagacgtcttctgtgaccccgaggagcacaaacacacccgcaggcagctggaagacatccgcctggatggcaaccccatcaacctcagcctcttccccagcgcctacttctgcctgcctcggctccccatcggccgcttcacgtagctcggagcccttccactcctcccaggtcatctcttggaccagcgggcatcacattctccagcagccgccatctcacacgcctccctcctgtggccgccggcagcatggacaaaggtctccatgcagggggaggaggcctgcttctttccccacagctctcacgtctcccttctccctgcgggtgacaaagaagcccaaggaccacctccttcctgcctcattgtaataaaattccccacactga

SEQ ID NO: 689 - DNA, 2246 bp, Homo sapiens
tttgtatgggctgcagcctgccgctgagctgcatcatggtgcggtctgtggcctgggcaggtttcatggtcctgctgatgatcccatggggctctgctgcaaaactggtctgctacttcaccaactgggcccagtacagacagggggaggctcgcttcctgcccaaggacttggaccccagcctttgcacccacctcatctacgccttcgctggcatgaccaaccaccagctgagcaccactgagtggaatgacgagactctctaccaggagttcaatggcctgaagaagatgaatcccaagctgaagaccctgttagccatcggaggctggaatttcggcactcagaagttcacagatatggtagccacggccaacaaccgtcagacctttgtcaactcggccatcaggtttctgcgcaaatacagctttgacggccttgaccttgactgggagtacccaggaagccaggggagccctgccgtagacaaggagcgcttcacaaccctggtacaggacttggccaatgccttccagcaggaagcccagacctcagggaaggaacgccttcttctgagtgcagcggttccagctgggcagacctatgtggatgctggatacgaggtggacaaaatcgcccagaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgagtcttccatacttgccttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcagcggggcggctgttccagcaaagctgcccgacaggcctggtgttcagcaactcctgcaaatgctgcacctggaattgagtcgctaaagcccctccagtcccagctttgaggctgggcccaggatcactctacagcctgcctcctgggttttccctgggggccgcaatctggctcctgcaggcctttctgtggtcttcctttatccaggctttctgctctcagccttgccttccttttttctgggtctcctgggctgcccctttcacttgcaaaataaatctttggtttgtgcccctcttcccaaagatgtggtgacttaagaggctctctaagcacactgttgactccaaaacatccgcaggtcagagccaggtgggaaggtggtccgtgcaggatgtgccaggccctgtggcaggtcttgccccatgagtccatatgccagtgggcagtttccagtacacaggtgatggcagccagagcgcggccccaagtgcaacacgttctttggttattggctcagaagcctggaaacaggagcttctgcggaccttcacgcacgtgttattcccaaaatgccactagatggcagcagagaagaacttttccctgatttaagcgctctgcgagcagccactcagcattacactaagaattcagacccctggtactcaggggtcttcgagataaatcctgtttgggccctttgcaggccctatctcacctactgcccccgttcaccagatgaagaaggaacaatgattattctcactttataggcatttaaactgaagactgattctaaccaattctgagtccagaaccaaggcctgaaatgggccagagagcatgcacacggtgtcctggttaaataaagtcatcccaacattc

SEQ ID NO: 690 - DNA, 2336 bp, Homo sapiens
gtccgacggtccacccagtgcttgcggcctcgcggccgggccggcctgggctgcaatcaatgcggctttgtctgggacgcccacatcccagaggccattcccgggtcggcaaatcggagcgcggccggggcgcgcggggccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaggtgtaagaga

SEQ ID NO: 691 - DNA, 2829 bp, Homo sapiens
actaaactagcttccccttagtacattgaaattcaaagtcatgcttgtaactgttaatgaaagcagatttaaagcaacaccaccatcactggagtatttttagttatatacgattgagactaccaagcatgttgctcttattcagtgtaatcctaatctcatgggtatccactgttgggggagaaggaacactttgtgattttccaaaaatacaccatggatttctgtatgatgaagaagattataaccctttttcccaagttcctacaggggaagttttctattactcctgtgaatataattttgtgtctccttcaaaatccttttggactcgcataacatgcacagaagaaggatggtcaccaacaccgaagtgtctcagaatgtgttcctttccttttgtgaaaaatggtcattctgaatcttcaggactaatacatctggaaggtgatactgtacaaattatttgcaacacaggatacagccttcaaaacaatgagaaaaacatttcgtgtgtagaacggggctggtccactcctcccatatgcagcttcactaaaggagaatgtcatgttccaattttagaagccaatgtagatgctcagccaaaaaaagaaagctacaaagttggagacgtgttgaaattctcctgcagaaaaaatcttataagagttggatcagactcagttcaatgttaccaatttgggtggtcacctaactttccaacatgcaaaggacaagtacgatcatgtggtccacctcctcaactctccaatggtgaagttaaggagataagaaaagaggaatatggacacaatgaagtagtggaatatgattgcaatcctaattttataataaacgggcctaagaaaatacaatgtgtggatggagaatggacaactttacccacttgtgttgaacaagtgaaaacatgtggatacatacctgaactcgagtacggttatgttcagccgtctgtccctccctatcaacatggagtttcagtcgaggtgaattgcagaaatgaatatgcaatgattggaaataacatgattacctgtattaatggaatatggacagagcttcctatgtgtgttgcaacacaccaacttaagaggtgcaaaatagcaggagttaatataaaaacattactcaagctatctgggaaagaatttaatcataattctagaatacgttacagatgttcagacatcttcagatacaggcactcagtctgtataaacgggaaatggaatcctgaagtagactgcacagaaaaaagggaacaattctgcccaccgccacctcagatacctaatgctcagaatatgacaaccacagtgaattatcaggatggagaaaaagtagctgttctctgtaaagaaaactatctacttccagaagcaaaagaaattgtatgtaaagatggacgatggcaatcattaccacgctgtgttgagtctactgcatattgtgggccccctccatctattaacaatggagataccacctcattcccattatcagtatatcctccagggtcaacagtgacgtaccgttgccagtccttctataaactccagggctctgtaactgtaacatgcagaaataaacagtggtcagaaccaccaagatgcctagatccatgtgtggtatctgaagaaaacatgaacaaaaataacatacagttaaaatggagaaacgatggaaaactctatgcaaaaacaggggatgctgttgaattccagtgtaaattcccacataaagcgatgatatcatcaccaccatttcgagcaatctgtcaggaagggaaatttgaatatcctatatgtgaatgaagcaagcataattttcctgaatatattcttcaaacatccatctatgctaaaagtagccattatgtagccaattctgtagttacttcttttattctttcaggtgttgtttaactcagttttatttagaactctggatttttagagctttagaaatttgtaagctgagagaacaatgtttcacttaataggagggtgtcttagtccatattacattgttataacagagtatcacagactggataacttctaaccaatagtttatttgtttcataaatctaaaagctgagaagtccaagatggtggggctgcctctggtgagggtcttctcgaagcatcataatatgctggaaggcatcacaacatggtggaagggatcacgtggcaaaagagcatgtacatgggagtgagagaaaaagagagagagagacagagtggcgggggcggggaggagcgcaaactcatcctttataaagacaccactcctgagataacaatccaatcccatgataatgacattaatccattcaagaagatagagctctcgtgacttaatcaccttctaaagatctcacctgacaacactgttgcattggcagttaagtttccacgtaaactttcggggacacattcaaaccacaggagaaactcaaattgttcctgggcaaatcacaacatggggaattttattcataaatgtccacagaaacagtaaatgttctcgcttcagtacttaattcatctaatccctcctgtttgtctcaaattataggataactttgaaactttctgaattaacgttatttaaaaggaaatgtagatgttattttagtctctatcttcatgttattatcacttaaaaacctgcgaaagctgtcaacttttgtggttgtagcaagtattaataaatatttataaatcctctaatgtaagtctagctacctatccaatactaaataccccttaaagtattaaatgcactatctgctgtaaa

SEQ ID NO: 692 - DNA, 2889 bp, Homo sapiens
ttcgtggctctctgtgtaactggtttttacttggttacatgccaccaggaactgctgattattttaaagtcctactaccctgcagctcactactttaccttgatttggaagatcatggaatatctatttgaatcctggatgtatttttctcacagtcttcttgcttcctgaaatttcctctggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaagccggcagggatttagcacaagatacaagatatacagggagtttggccgctggaaagtaaataaccttgcagttgagagaagaaatttccttggctctcctctgcctcttgcccctgaattcttccgcaacataagacttttgggacgtcgacctacccttcagcaaatcacagaaaaccttatcaagaaatatgggacacatttcttgctatctgctactctgggaggagaggagtcactcacaatttttgtggacaagcggaagttgagcaaacgagctgaaggaagtgattccaccaccaatagctcttcggtcactctggagacgctacatcagctagccgcttcttatttcattgacagggacagcacccttcggagacttcaccacattcaaattgcatccactgccataaaggtaacagaaacacggactggtcctcttggctgcagtaactatgacaacctagattctgtcagttctgttctggttcagagtcctgagaataagattcagttgcaagggcttcaagtacttctcccagactatcttcaggaacgttttgtacaagcagctttgagctacattgcttgcaattcagagggagagtttatctgcaaggaaaatgactgctggtgtcactgtggtcccaaatttccagaatgcaactgcccctccatggacattcaagccatggaagagaatcttcttcgaataactgaaacctggaaagcttacaacagtgactttgaggaatcagatgaattcaagttatttatgaaaaggctacctatgaattatttcctcaacacatctactataatgcatttgtggacaatggattctaattttcagcgccgttatgaacaactggagaacagcatgaaacaacttttcctaaaggcgcagaaaattgtacacaagctttttagccttagcaagaggtgtcataaacaacccctcatcagcctgccaagacaaagaacctcaacctactggcttactcgcatccagtcttttctctactgcaatgagaacggcctcctaggcagcttttcagaagagacgcactcgtgcacgtgtccgaatgaccaggtggtctgcaccgcgttcctgccctgcacagtgggagacgcctctgcctgcctgacatgcgcaccagacaaccgcacccgctgcggcacctgcaacaccggctacatgctcagccaggggctctgcaagcctgaagtcgccgagtccaccgatcactatattggctttgaaactgacctgcaagatctcgagatgaaatatctgctgcagaaaacggacagacgaatagaagtccatgccatttttatcagcaatgacatgcgcctcaatagctggtttgatccctcctggcgtaagcggatgctcctcaccttgaagagcaataagtacaagtcaagtctggtccatatgattttgggtctctctttacagatttgcttaactaaaaacagcaccttggagccagtgttggctgtttatgtcaatcccttcggaggcagccactctgagagctggtttatgcctgtgaatgaaaacagctttccagactgggagcggactaagttggacctacccctgcagtgttataactggacattaactctggggaacaaatggaagacattttttgagacagtacacatctacctgagaagtcgcatcaagtccaatggtcccaatggtaatgagagcatttactatgaacctctggagtttattgacccttcccggaacctgggctatatgaaaatcaataacattcaagtgtttggctacagcatgcactttgaccctgaagcaattcgggacctgattttgcagctggactacccctatactcagggatcccaggattcagcacttttgcaactactagagatcagagaccgtgtaaataaactctccccacctggtcagcgtcgtctagatcttttctcttgcttgcttcgtcatagactcaagctgtctactagtgaggtggtgaggatccaatctgctctgcaggcgtttaatgccaaattgccaaacacaatggattatgacacgaccaaattatgtagttaaccataaatgtcaagcacaacccaaaatcttgaaggagtttttacagtgcttttgtggaacagtttatgtttggaagagtaaatttaaattgtcttttcaatatctgtcttatatcagtcaataacattggatggcaatttacacacatgaacttgctgacaatgaatatattatacagcagttttggtttatgaatgacataaatactgacaccagtctagaagacattctactttttacaataaatttcatttgtaattttatatgttccgtggcaatgcttttgtgcattacatcctctagagggaacataaaaagataccaataaaattttgtagctgaacagttattaaaaa

SEQ ID NO: 693 - DNA, 2519 bp, Homo sapiens
cagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacactgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 694 - DNA, 9311 bp, Homo sapiens
gaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacactgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaagcattggtgtgttctttaacttgctacttggagacctagtgtccagtctggacagaatgcacagagaccagcctcacctggaatgcagccagactcgatgtccctcagcacacacagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgctgataatgaacctcattaagggggagcaggagcctcaatccgatttggttttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcacagctgcctctggcagccaagcctcttttcgcccggccccagcccctctggttgataaacgggtgggcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtccaggctggaggggcccaatgtaggtgtagagggactacagccctgaggggctgctccatgcggcattcttggaggtccaagaggggcagcgccaccttgggccaggctcctctccagcagccttggtatggggtgggggtgggaagacccctgatgcagcctgtcctctgggtgtgggggtggaggagagggctccaggggacccagccagccttgaccctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatccccttgtccccatgtgtcattggagataaactacccacctaccagattgttgtaccatgctgggcaaacactaagtgcttaataatggtagcccactgctcatgtcgtgtcgtctcctgtcttgatacctgaaaactcaaggggccctgttgtgcttggaggggggtgccgttcccacaggatattctgtgaagggtgtccctggagctgggcctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctcccaaatggtgagaggtagatccaggacttgaccccagatcccacccactcaaccctggagctgcagtctctaccccttctaacacatgtgattctgtttcatgtcctgttccatcggtagagttacacactttcctgagactttatatggtggtgctgctgggtgccagcccttcttccctccaacagtggcagtaaccactgttgtgtgttggtgtcaaggagtggggacaccctgaaggaatccgccttttctagagctctcgctccattccctacatcgaggctgaagtgccctgtctcgggtccttgtttttaggcctcgtttgaaggaggggaagaaaccaggttcgttgggcgtgaccttggctcagctcgtctgtgaaattggggccgcagacttagtttgcgggtccctgctaaattcctctccctcttcctgggattcccatccatgtattgccagctacatgtagagtggagaggagaggtttttcctgcagggccttccagagaaaggattcttggccagaggaaatcacagcctataagatcaatatcctgatagaatcccgggccaggtgtgagaggggagagctcactcacaccagcctgacagtcttggggcagagcgccccataggcctctgcagccccatcactgcctcattctccctcaggtgccaaggaagctccagggtgggcccagtatccttccacagcatccctcctcttccccttcaacacccctttcacccctccctccaccacctctgaaaggtgctccttgggcagggcgataggattcccacccctagctttaagaactaaaccaaacttcaagaggagcaatttaatcttcatacctgactccttgtccctcctcaggcatgctgttgtgcaggacagagccctggcttctcctggatgtcacacctggcctgtctctgacccttgctttccctttctctgctgccctcaagggtcattcacacccaagagggtaagaagctgccctctcatcccttcctctcccaccctgggcctctgccctctgcctggccccagcagcacagtcttctccatagagaggggctgggccatgggaccccagttcctggggtctcggtgacacagttcactgtttgctgcagaggaggccccactcgcagccttggcctctgccctgcagaagaattccctgtaactcactcaccaatggccgtgggagccagtggcctcggcgagggtcagttggactgcatagctgccggctgagtctctctggccaccctcactggccccatcactccaggttgcactgctgcccagggggtttgtgccaggcctgggtcacagtggaagagagtctggaaatcacaaggcagaggaggagacctttgccaatgtgagagaacaaagttaaggggcagtccatgggggcattgaccttacttaggtgaggaggactcagggaacatctacagactctagggctagggtgagatcctcctgatagtgctggtagctccagctgctgctttggcaagacttggtcgtctctatactgagagagcaaaagctcttttcctggggctgcatgttcttccataggaaagtgggcttcaggtgctgcctattaaacctcctgcctcccctgctgcagtgctttgatgcctttcacctgtgtctacctgcgaacctctgcccaccacggaagagcagctcacatttggaaggggctaaaatttttacctagtttgaatctgctctgcaatgtccccatcaagttcttaaccatcccgggttccaatggttacagagttctgccctggggagggaggaattgcttagcaaatgatgttgagaatagtgattatttgggggaaaattcaggtaagatctcaccttcataccatataccaaaatacatctcagtagattagtaagctaatgcaaaaaaaaaaaaaaaaggggaaatataattgaatacttcactgtttttgaaagcatgaaaacaatggaaaatgcaactgatgtgagtaatccatctacttgacgtcacttttaagaaataaggccaggcacggtggctcacgcttgtaatcctagcactttgggaggccgaggtgggtggatcacgaggtcaggagtttgagaccagcttggccaacatggtgaaacccccatctctactaaaatattacacaggcattgtggcacacatctgtaatcccagctactcaggaggctgaggcaggagaatcacttgaacctgggaggtggaggttgcagtgagctgagatcgcgccattgcactccagcctgggggacagagcgagactctgtctcaaaaaaataaaaaaataaaaataaaaaaataaagtaaagctacatatttaaaagctggggaaatatatgctgtaaatatgacaaagggctgtgactcttctgcaacacaccattttaagaatgagctaggtctgcatttattgacctgataaaatgtcccaagaaggacacatttttataaacataagttactattgttatatatatgctaacgtttgtctagaaaaagtctagaaaaatacacactgaactgtgaatagcagttatatttagaaagcaacattaggatgaacttaagtcagggcttggactagagcaaggcaagtgaggtgccaggatgcaaaagttaaggagacacctgacctcaggggcccacaactgcagagcccctgacagtgagtgtctcagtagcctcgccctagtcctggctttcacttaaatatgttttcgaatgtttgtaataaaatatttcttttggaaggcaaaaatagcaaggaaaataaataggattaaaggatactaaagcccattcaataaaatttgtaggaggccactgatttggcctaggctcctatgatgtaaccaacagaccaaaccaatatggagtcattcatgctaaatgaaactagttaggagtatattcatataacaagtggctaagtgtcagttacagcctctgagctttagtcaattgtaggtggtcaatagattcagataaggcaatccagttaaactgtatatcccacttgctgttttctgtccctaaattctctctgagtacactgcagccctgaagttctttgaacctgttctgggttctgagggctgtccaattactgaatcatacataaaagccaagtaagattttaaaatttgttataattttggtttttaacaacttctgttgtaaataataaaagcactaaatccctactgaaaataaagggcctaaagactgaa

SEQ ID NO: 695 - DNA, 2289 bp, Homo sapiens
agacagagcaaagccacaacgctttctctgctggattaaagacggcccacagaccagaacttccactatactacttaaaattacataggtggcttgtcaaattcaattgattagtattgtaaaaggaaaaagaagttccttcttacagcttggattcaacggtccaaaacaaaaatgcagctgccattaaagtcacagatgaacaaacttctacactgatttttaaaatcaagaataagggcagcaagtttctggattcactgaatcaacagacacaaaaagacatcattttacaacctcatttcaaaatgaagacttttacctggaccctaggtgtgctattcttcctactagtggacactggacattgcagaggtggacaattcaaaattaaaaaaataaaccagagaagataccctcgtgccacagatggtaaagaggaagcaaagaaatgtgcatacacattcctggtacctgaacaaagaataacagggccaatctgtgtcaacaccaaggggcaagatgcaagtaccattaaagacatgatcaccaggatggaccttgaaaacctgaaggatgtgctctccaggcagaagcgggagatagatgttctgcaactggtggtggatgtagatggaaacattgtgaatgaggtaaagctgctgagaaaggaaagccgtaacatgaactctcgtgttactcaactctatatgcaattattacatgagattatccgtaagagggataattcacttgaactttcccaactggaaaacaaaatcctcaatgtcaccacagaaatgttgaagatggcaacaagatacagggaactagaggtgaaatacgcttccttgactgatcttgtcaataaccaatctgtgatgatcactttgttggaagaacagtgcttgaggatattttcccgacaagacacccatgtgtctcccccacttgtccaggtggtgccacaacatattcctaacagccaacagtatactcctggtctgctgggaggtaacgagattcagagggatccaggttatcccagagatttaatgccaccacctgatctggcaacttctcccaccaaaagccctttcaagataccaccggtaactttcatcaatgaaggaccattcaaagactgtcagcaagcaaaagaagctgggcattcggtcagtgggatttatatgattaaacctgaaaacagcaatggaccaatgcagttatggtgtgaaaacagtttggaccctgggggttggactgttattcagaaaagaacagacggctctgtcaacttcttcagaaattgggaaaattataagaaagggtttggaaacattgacggagaatactggcttggactggaaaatatctatatgcttagcaatcaagataattacaagttattgattgaattagaagactggagtgataaaaaagtctatgcagaatacagcagctttcgtctggaacctgaaagtgaattctatagactgcgcctgggaacttaccagggaaatgcaggggattctatgatgtggcataatggtaaacaattcaccacactggacagagataaagatatgtatgcaggaaactgcgcccactttcataaaggaggctggtggtacaatgcctgtgcacattctaacctaaatggagtatggtacagaggaggccattacagaagcaagcaccaagatggaattttctgggccgaatacagaggcgggtcatactccttaagagcagttcagatgatgatcaagcctattgactgaagagagacactcgccaatttaaatgacacagaactttgtacttttcagctcttaaaaatgtaaatgttacatgtatattacttggcacaatttatttctacacagaaagtttttaaaatgaattttaccgtaactataaaagggaacctataaatgtagtttcatctgtcgtcaattactgcagaaaattatgtgtatccacaacctagttattttaaaaattatgttgactaaatacaaagtttgttttctaaaatgtaaatatttgccacaatgtaaagcaaatcttagctatattttaaatcataaataacatgttcaagatacttaacaatttatttaaaatctaagattgctctaacgtctagtgaaaaaaatatttttaaaatttcagccaaataatgcattttatttataaaaatacagacagaaaattagggagaaacctctagttttgccaatagaaaatgcttcttccattgaataaaagttatttcaaattgaa

SEQ ID NO: 696 - DNA, 4369 bp, Homo sapiens
gggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaagtacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacgggtatcaccactgtcttgttttgttttctgttaagaatacatgggggcctttgagagctgggagggtggaggtgtgggagctgatgggagaatgattaagtggtcatttgtgtcggagagttgaagtgtatttattataaggtattattattttttcatgtctttgaagaacttgaagaaatactgacatattaaggtactttgttcactgaattctcctctactagatattttaaaatatacttctatcctcgatagtaaaaaaggcacagagccaaaagccctcttgtgatccccttgacttctagaatgtggttattcttatttttgcccgcattcttagacatttactctgaagaagagtccaatggaaataaaggaaaagagtttatgggtcaaggtggcccattgtactgtttttgaagttggtcaacaaggtggcttggttaatttaggctcagcatgttttactgtatgttactaaaaaaaaaaaaaaaaaaaatcagattctctttttccagcactagtcaagcacaaattcttagctgcctaccaccctttccccaccaaaaggtgacatctaattttaaaaaaatggcatcttcctggccctcggaaaaacttgtcatctggtctttcttgccttaattcagcttctgtattattcttcgctgtctctcacgccttccttgtttcttgtgaaaagtaatagtgactggtttcctataatggactcaaagttatccctaaaattaaagacttatttgatgaccta

SEQ ID NO: 697 - DNA, 9685 bp, Homo sapiens
gggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaagtacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccaaccaccgtcccctaactggctggtttccctgtgttgccagtgaaaatgaaactcaggatgacaggagtgaacagccagaaggtagcctgaagaaagaggatgaggtttggctcaaagtgtgtttcaatagaccaggagaggccagagcaatttttatttttttgacaactgatggcctagttcccggagagcatcagcagccgacagtgactctctacctgaccgatgtccgtggaagcaaccactctcttggaacctatggactgtcatgccagcataatccactgattatcaatgtgacccatcaccagaatgtccttttccaccataccacctcagtgctgctgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagcccttccaagcagatggttggtgtgacactatcaacaaccgagcctactgccactatgacgggggagactgctgctcttccacactctcctccaagaaggtcattccatttgctgctgactgtgacctggatgagtgcacctgccgggaccccaaggcagaagaaaatcagtaactgtgggaacaagcccctccctccactgcctcagaggcagtaagaaagagaggccgacccaggaggaaacaaagggtgaatgaagaagaacaatcatgaaatggaagaaggaggaagagcatgaaggatcttataagaaatgcaagaggatattgataggtgtgaactagttcatcaagtagcccaagtaggagagaatcataggcaaaagtttctttaaagtggcagttgattaacatggaaggggaaatatgatagatatataaggaccctcctccctcacttatattctattaaatcctatcctcaactcttgccctgctctccgctccaccccctgccaactactcagtcccacccaacttgtaaaccaataccaaaatactagaggagaagttggcagggatactgttaatacccattttgaatggattgccatctttcagagcttgtctgctctcaactggctctttttctttttgtgtagtttcccttaaataatgaagttagttattaattctttataagtatttaaacataattatataaatatattatatatattatattttttgctgtttactaagctaaaaattattcattgttccacacatgctgctgtgaagttcacattcaagatgaatgttgagactttgaggacagaaaggcaacttattttcccatctttctatggatgcggattggcaggttgaatgggaagtacagaaggagagagagtaattagatggaattctggatgctagcatgtaaagctaatcatctttttttttatgacctgggagctgggcccattttatgaccaaggagatggggagttggaatggtggtactaagaggcataggaagttgagtgtgaataccattggtgatgggtccaggagaactagactatggttcttgaatatctgtccacaaagaatatactaacttttgtcaacttctcagaactcccaactggagtcggtgagacctaggattttctgcacttccacacatgcctgttccaagtgtggctgtcagccagtcaacaagtttgtactatggcccattctctgatcaccaggattacaggaactcacacactcctcatacttggcctgtagtcctacttcttgttagaagtctccaagtctggccagtcacatgaccaagtgttgatttttctggaggaaaaattttatggaaatgatataggggaaaggtgggaggagatgaaagaacaggcaagagctgtcagggttaaatccaggcccgggcatgagaatggaagtgatcagggagactcggtccttgttccaagtctccaaagaagaccaaagtgggtcccttgagcaatgaagaatctgagataaattctcttcaagtatcatgtacaaaatctgtgagccagagattttgacttgagcaagccatggaaatgcatggagcaagggtgacactctgtggggagacagaagaatttcaactatttaatgtccattttgttgtttttaccctttcttatccaatagatggaatgcacatgaaatgaccatattaagcctctctctatttacatcccaggctcactgggatgtgatctactgcagttacattttcttgtaacggtttctggattagaccctagggaaagtgagtaaggagccagtttctgtttaacattctagttttactcattttaggaaggctgtgagtgaggcttgtctcctttaaagtttcttctccaatggaaaccaagaacagacaaaatttagagctcagctgtggtctcttctcatcttctgctcttttgctttgaccacagtttttctactcttcccatcaacactagagcaatggctgtgcaaataggaataggaaatactaccacaatgatagaaatattatccacactatcacgtagggaagaacaatatcctgaaagagaataaaacacgaataaggtgatgtacccacattaatctgtgggtttgtggaatgagggttgcaaagttattgggaaaaggaaagagcagagttcacccattcaaaaaaaaccttttgtctactaatctctagtgtaaagaaaatgtagttcagataccattcattgtcttgggtcatgcttagtgcccccaagaagacaaacatatttattcttgggattctgataggcttcaatatgcaaaggacaatggaaaagtttagacactctattttcaaaattttataaacttgttttattggggaaaatgtccaaattgctagacacattctaagttctgccttggagaatcctactttgtctgagattgaggcagaggaattgttatcctgggcattactcagctcaggaacatggagcctgtggttcatgccagtgtgtgtcttcatgcagtctctccacaagagcaacagtaagaacatttctgttttaaatttcattttaaaatattttattatctgcaattcaccactgctctgggaaagcaaaaggaaagttcctgttgtgtgtgaagagcctcttaggctataaggcttcccagccatagtcagctatagctattcagagacagcaggttcttccagtctttgttcctgggacctgatgttttgagcaactcaggtcactgataaagtggaaggactaagacactgtggtcacagatcccagcaacatcaactcacactcaatccatgtggtggtccacattctgctactcttatccacccatgtggtcattgagagcctttctcagagactcttctgtgtgtttgattgtgcccaggtggcccagggctagctggctctaacaactagcatgacagcctccaatcagaaaggcaggtaaggggacagggtgaggagaatgggcagatactgacagaaattaaagtaaagggattgtgaaagtaaagagctcttcctgattctcatcttctcttttttctattacaaggcattgaacttggcacttcctgtattctttgtgatcactattgagtgcattagttaacacccaaggggatggcttgattgggaatgtagtgaaaggagctgatctactgtattgtaatgtaaaacagctacagccagttattttgtaagattataagttgttcattaaaaaatcagcacacaaaa

SEQ ID NO: 698 - DNA, 1153 bp, Homo sapiens
agaacaggagcaaagcatagtggtgtgaaagttgccaaagatgggcatggtggaggctcaagtgtagggtcaagtgtagggtggatcaggggagtagcaggagatggtgtggaaaaatgtttggggtcaggttatacagggctgttaaagcctgccgaggagtccagactctaaatggatgaacagcaaaggtttaaggggtgaggcatcactagatcagcccaaaacctccatccacctcttctccaccaggaaggtgcaaggacactctctccacaatcacggggccgaccacccagaacacatatgggcggaatgaaggggcctggatgaaggaccccctggccaaggatgagcggatttacgtaaccaactattactacggcaacaccctggtagagttccggaacctggagaacttcaaacaaggtcgctggagcaattcctacaagctcccgtacagctggatcggcacaggccacgtggtatacaatggcgccttctactacaatcgcgccttcacccgcaacatcatcaagtacgacctgaagcagcgctacgtggctgcctgggccatgctgcatgacgtggcctacgaggaggccaccccctggcgatggcagggccactcagacgtggactttgctgtggacgagaatggcctatggctcatctacccggccctggacgatgagggcttcagccaggaggtcattgtcctgagcaagctcaatgccgcggacctgagcacacagaaggagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggtgggtatgtgttgtttaaaaatatatattattttgtataata

SEQ ID NO: 699 - DNA, 1792 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagct

SEQ ID NO: 700 - DNA, 823 bp, Homo sapiens
gccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgc

SEQ ID NO: 701 - DNA, 2066 bp, Homo sapiens
atgaagctgggctgtgtcctcatggcctgggccctctacctttcccttggtgtgctctgggtggcccagatgctactggcagctggatgtcatgccgctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaa

SEQ ID NO: 702 - DNA, 1684 bp, Homo sapiens
gtttcatgttgaagaaaatcagtgttggggttgcaggagacctaaacacagtcaccatgaagctgggctgtgtcctcatggcctgggccctctacctttcccttggtgtgctctgggtggcccagatgctactggaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaa

SEQ ID NO: 703 - DNA, 2362 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggcagctggatgtcatgccgctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagct

SEQ ID NO: 704 - DNA, 1012 bp, Homo sapiens
gccgggggcgcgcgctctgcgagctggatgtccaggctgcgggcgctgctgggcctcgggctgctggttgcgggctcgcgcgtgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggtgctgggatccagaaggtggggtgggggagattggggccctaccctcctgactcttgcccacaccaggtctaaaataattttagtctagaggggcagaacacagctttctggacccccatcagggctggggaacagtgttcagaagtcccctttacatgttggccccatgaagagaccacggcccaagggtacgtggagctcgttggacgagagttcctcaggtgggaactgaggggacttcccactcctctgggactagggtaaactaaggtgtagaaggggacgagacatctggcctcttcctgaacaccaccctctt

SEQ ID NO: 705 - DNA, 901 bp, Homo sapiens
gccggggccgggccgggccgggggcgcgcgctctgcgagctggatgtccaggctgcgggcgctgctgggcctcgggctgctggttgcgggctcgcgcgtgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatatccctcacagcccccaaaaaatctgcaacccagtttaccggtcgctaccattacctggggggtcgttttgtgccacctgctctggagaagaagtaccagctgaacctgccaccctaccctgacaccgagtgtgtctatcgtctgcagtgagggaaggtgggtgggtattcttcccaataaagacttagagcccctct

SEQ ID NO: 706 - DNA, 1125 bp, Homo sapiens
gccggggccgggccgggccgggggcgcgcgctctgcgagctggatgtccaggctgcgggcgctgctgggcctcgggctgctggttgcgggctcgcgcgtgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatatccctcacagcccccaaaaaatctgcaacccagtttaccggtcgctaccattacctggggggtcgttttgtgccacctgctctggagaagaagtaccagctgaacctgccaccctaccctgacaccgagtgtgtctatcgtctgcagtgagggaaggtgggtgggtattcttcccaataaagacttagagcccctctcttccagaactgtggattcctgggagctcctctggcaataaaagtcagtgaatggtggaagtcagagaccaaccctggggattgggtgccatctctctaggggtaacacaaagggcaagaggttgctatggtatttggaaacaatgaaaatggactgttagatgccaa

SEQ ID NO: 707 - DNA, 1290 bp, Homo sapiens
gccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaatgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaaaatgcaaagctgactgtgatacctgtttcaacaaaaatttctgcacaaaatgtaaaagtggattttacttacaccttggaaagtgccttgacaattgcccagaagggttggaagccaacaaccatactatggagtgtgtcagtattgtgcactgtgaggtcagtgaatggaatccttggagtccatgcacgaagaagggaaaaacatgtggcttcaaaagagggactgaaacacgggtccgagaaataatacagcatccttcagcaaagggtaacctgtgtcccccaacaaatgagacaagaaagtgtacagtgcaaaggaagaagtgtcagaagggagaacgaggaaaaaaaggaagggagaggaaaagaaaaaaacctaataaaggagaaagtaaagaagcaatacctgacagcaaaagtctggaatccagcaaagaaatcccagagcaacgagaaaacaaacagcagcagaagaagcgaaaagtccaagataaacagaaatcggggattgaagtcaccctagctgaaggcctcaccagtgtttcacagaggacacagcccaccccttgcaggaggaggtatctctgagtgtgcagcacagaatcgcatgacccaccttaaccttcctgttgtcatggaaggatgcacggctgctctgtccactgtgattcctagccctctcaagatcactgctttctgaagaatttgcaatgactctggcttctggctgcttatctctggacacccgttctccaccagttgtacagttcatgtaatctacttggcttaattgattttccacttctctcttcctcttctaagatataaacattttaaatgattt

SEQ ID NO: 708 - DNA, 3145 bp, Homo sapiens
gtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaa

SEQ ID NO: 709 - DNA, 2116 bp, Homo sapiens
cttgcatttctccaggtgctgtgaaaggagctggctcagagccttgccctctgtcttcccttctccccatcttttgttagggatcctgggctctcttctctctgggaagctagagcccgagtgctccattcccagggagggagtgccctctagggctagggagagtgaaggctggaggagaaggcgccagttggtgaagaagggcagggcctggaggccaagtctggaagggaaggagctgctggccaatcaggggcaagctgactgcaccctgacctgctgggctgggacagcacaggacccacagatatctgctgccatccacactctccagattggtgtcctgggaccacgtggggatgctgccgtggcttcttgtcttctctgctctgggtatccaggcctggggtgattcctcctggaacaaaacacaagctaaacaggtatcagaggggctccagtacctatttgagaacatctcccagctcactgaaaaagatgtctccaccacggtctctcgcaaggcatggggggcagaagctgttggctgcagtattcagctgaccacgccagtgaatgtccttgttatacaccatgtccctggactggagtgtcacgaccagacagtctgcagccagagactgcgggaactgcaggcccatcatgtccacaacaacagtgggtgtgatgtggcctacaacttcctggttggggatgatggcagggtgtatgaaggtgttggctggaatatccaaggagtgcacacccaaggctacaacaacatctccctgggctttgccttctttggcactaagaaaggccacagtcccagccctgctgccctgtcggccatggaaaacctaatcacctatgctgtccagaagggccacctgtcatccagttatgttcagccacttcttgggaaaggcgagaactgcctggcccctcggcagaagacaagcctgaagaaggcttgccccggcgttgtcccacggtctgtgtggggagccagggagacccactgtcccaggatgactctcccagcgaagtatggcatcattatccacactgccgggaggacctgcaacatttctgatgagtgccgcctgctggtccgggacatccagtctttctacatagacaggctcaagtcatgcgacattggttataacttcctggtgggccaggatggcgccatttatgaaggggtgggctggaatgtccaaggctcctccacccctggctacgatgacattgccctgggcattaccttcatgggcaccttcacaggtataccacccaatgctgcagcactagaggcagcccaagacctgatccagtgtgccatggtcaaagggtacctgactcccaactacctgctggtgggccacagtgatgtggcccgaaccttgtctcctgggcaggctttgtacaacatcatcagcacctggcctcatttcaaacactgagagaagccccaggtccttctgagactgctttccctcccctgtcaggtctctcctgtcctaaccatccagcttggctcaacaccttttgccctcctcccctgccacacagtcctgtgcctcctttttcaggttgggatgatcatgccctctcctgccaacatcctccaagggcctccaaacctcatagctggacattcacagccctctgagtctgagtccagatttcttctctccttaccttcctctcccttggaaacccaactcctcagccaggtgagacaatgggctggttcttgtttcatttctctctctctctccattcccctctgcctggtgagccttcccctggtgtctgcctggcagcccccacctcccacctatcacccctcacccataactcaggtcaacgtgaccaaccttccttgcttacacataaacttgtatatatttggatgtagcccttatttaatggctgtcattatttatagatatgtctatccttgctacttggttgtgagtttctccaggggaggaactgtgttttattcatctctatgtcctctgtttctcagcagtgtctgaaatttaatgggttctactgatgtttattagagaaatggatgaataaatgaatgaagagatccaaa

SEQ ID NO: 710 - DNA, 2642 bp, Homo sapiens
gggtaggtaaagaagaggcatggaggtgaatgcaggcagcagctttcagggaagaagaagcatcaggctgcagaccttgcctcctccctgccctgatggcaggactgaggcctcccagggatgaagaaactgaggctgaggcagttcaacaacttgcccaaggccacgcagcaggtaaacacagcaacaaaaaagttatgagaaccaagagctctgagaaggctgccaacgatgatcacagtgtccgtgtggcccgtgaagatgtcagagagagttgcccacctcttggtctggaaaccttaaaaatcacagacttccagctccatgcctccacggtgaagcgctatggcctgggggcacatcgagggagactcaacatccaggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatggatctggagacatgatatttgagggaaacagtgagaaggagatccctgttctcaatgagctacccgtccccatggtggcccgctacatccgcataaaccctcagtcctggtttgataatgggagcatctgcatgagaatggagatcctgggctgcccactgccagatcctaataattattatcaccgccggaacgagatgaccaccactgatgacctggattttaagcaccacaattataaggaaatgcgccagttgatgaaagttgtgaatgaaatgtgtcccaatatcaccagaatttacaacattggaaaaagccaccagggcctgaagctgtatgctgtggagatctcagatcaccctggggagcatgaagtcgggtctcattccgtctcccaggctggagtacagtggcacagtcttggctcattacaacctccaccttttgggctcaagcaatcctcccacctcagcctcctgagaagctgggattacaggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctacgaaggggtaatggccctggcccatctcacccaataggacatgggcagcgaggccccagctccagaggctcggagctgggaggctggtccctgggacgctggacccacgatggaattgacatcaacaacaactttcctgatttaaacacgctgctctgggaggcagaggatcgacagaatgtccccaggaaagttcccaatcactatattgcaatccctgagtggtttctgtcggaaaatgccacggtggctgccgagaccagagcagtcatagcctggatggaaaaaatcccttttgtgctgggcggcaacctgcagggcggcgagctggtggtggcgtacccctacgacctggtgcggtccccctggaagacgcaggaacacacccccacccccgacgaccacgtgttccgctggctggcctactcctatgcctccacacaccgcctcatgacagacgcccggaggagggtgtgccacacggaggacttccagaaggaggagggcactgtcaatggggcctcctggcacaccgtcgctggaagtctgaacgatttcagctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacaggcagagtttccctgcagaagctttctcttgcctgccgccgtgtgagatgtgcttttgctctttcttcatcttccaccatgattgtgaggcctccccagccatatggaactgtgcctcactctagtcctgaccctgttaccaccaaaatatccccactgaggaacttctagtgaatatatttcaagaagaagggaactaaccccaggaagaagactgaaagcttcatgaggataaactgagactcttcgctattgaaattctattgccaggcgcatcccccagcccacagtgaatggaattggattattctgaagcacaatcagtattccaagtacatggtttctgtaatgggataattggctgcccctggtcctagacaacacctgaagtttaatttctctgaaaggctctgccttgagcttgctttaaaacctgcaattataaggagacacctaatgagaccaggaggaaacttctacaccgcacagctatttttaaaaaatgggattaacaggagaaaatgtcaaacagggggatctccatgtttctgcaatgcatgacaggttacccagcgttcc

SEQ ID NO: 711 - DNA, 704 bp, Homo sapiens
ggagaccatgcgcaggcgcggtgcactgtgcgcgggcaccacggcggtttttcgacgctggcggtggacgcaggcagcatggaccacggttgctgggcggatggggagcgtctatggtcagttgccttagaagtggtgagatgggaagctgcagttggaagaccctggaggatgcctgacaaggggatgtctgacacatgattggagctctttttgaaatgtttcttgcccttcctggagcagaggagccattatttatgcagtgattatgcctgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggtgggcacaaaaatcttcatgagcaatacttcttagtagattgttttgttattcaaatcaagttctagtgtttttatgtgagattatataatttacagtgttgttttatatacttttgaataaatgtacactattaaaaat

SEQ ID NO: 712 - DNA, 745 bp, Homo sapiens
atgcgcaggcgcggtgcactgtgcgcgggcaccacggcggtttttcgacgctggcggtggacgcaggcagcatggaccacggttgctgggcggatggggagcgtctatggtcagttgccttagaagtggtgagatgggaagctgcagttggaagaccctggaggatgcctgacaaggggatgtctgacacatgattggagctctttttgaaatgtttcttgcccttcctggagcagaggagccattatttatgcaggtacatcgaagtcttttgacctccatacagtgattatgcctgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggtgggcacaaaaatcttcatgagcaatacttcttagtagattgttttgttattcaaatcaagttctagtgtttttatgtgagattatataatttacagtgttgttttatatacttttgaataaatgtacactattaaaaataatcctctttgctgccaa

SEQ ID NO: 713 - DNA, 2096 bp, Homo sapiens
ggcctcggttcaaacgacccggtgggtctacagcggaagggagggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaa

SEQ ID NO: 714 - DNA, 418 bp, Homo sapiens
tccttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctgtggaagaaggctgctatgactctttggatgggagtctggcaagaggaaattggaagataaaataaataataagtgaaat

SEQ ID NO: 715 - DNA, 600 bp, Homo sapiens
aggagaagagttgctgcagctccttccctgctttggaggaggaggggaggcggggtaagtttggtgggaaactctgtaatttccttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggcaagaggaaattggaagataaaataaataataagtgaaataa

SEQ ID NO: 716 - DNA, 1251 bp, Homo sapiens
aaagctgcttgaaaagtggaagttagccttccggatggttagggagacatggaccaggtagggtaactgtctccaccaagagactcatctgtagaaaagtgaacgcactggaaaggggagaaatctaattaaagagtcttcagagcgatgacagccagagtgtgcgagcacggaagggcgaggtatccgttcctggatcctcccctaaggcacctgactcggcctgcctaggtcagcacagccccctcacgagtctcggccttgggccttctctgacgtcgctgggaggaatataggaggaatctgtgagatccttggaaggtggaaaccaactgcgggaaaggacaaatctcccagacccaacccctcacctccgcccaaacttcacctccgacttatcgtccccaattcaggctcccaggcttgccccagttcctccagccccttccgcacctctctcttcgacgctctcccgcgtctcccgggccctctactcaccctgcgaccaggatgataacgcgaagcgggtccccagccacagtgatcaagaaaagcgcgaaggccgggccgaacgcgacgaaagtgcagccgaaaaacaccgcagcccccatggctggtcagctccagacagacagaagaaagggattcttttcagtctagaaaaatgctcaccccttcctcagaacatttccactgtgacgaaaagagactgatgaagcctcagagagaaaggcaactctgggtggtgatgcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggcaagaggaaattggaagataaaataaataataagtgaaataa

SEQ ID NO: 717 - DNA, 931 bp, Homo sapiens
agcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggc

SEQ ID NO: 718 - DNA, 931 bp, Homo sapiens; identical to SEQ ID NO: 717

SEQ ID NO: 719 - DNA, 2354 bp, Homo sapiens
ggtggaataacatgttcttttaaacgtagagtttaaacattgagttgcatcattgtgaggaaaaccacttagtattttatagtgaggtgactttacaagtaaagatcttcaagaagatttttatgtgatttaaaaaatcagcttagatgcttggaatttggattgttgcattcttgttctttggcacatcaagaggaaaagaagtttgctatgaaaggttagggtgtttcaaagatggtttaccatggaccaggactttctcaacagagttggtaggtttaccctggtctccagagaagataaacactcgtttcctgctctacactatacacaatcccaatgcctatcaggagatcagtgcggttaattcttcaactatccaagcctcatattttggaacagacaagatcacccgtatcaacatagctggatggaaaacagatggcaaatggcagagagacatgtgcaatgtgttgctacagctggaagatataaattgcattaatttagattggatcaacggttcacgggaatacatccatgctgtaaacaatctccgtgttgttggtgctgaggtggcttattttattgatgttctcatgaaaaaatttgaatattccccttctaaagtgcacttgattggccacagcttgggagcacacctggctggggaagctgggtcaaggataccaggccttggaagaataactgggttggacccagctgggccatttttccacaacactccaaaggaagtcaggctagacccctcggatgccaactttgttgacgttattcatacaaatgcagctcgcatcctctttgagcttggtgttggaaccattgatgcttgtggtcatcttgacttttacccaaatggagggaagcacatgccaggatgtgaagacttaattacacctttactgaaatttaacttcaatgcttacaaaaaagaaatggcttccttctttgactgtaaccatgcccgaagttatcaattttatgctgaaagcattcttaatcctgatgcatttattgcttatccttgtagatcctacacatcttttaaagcaggaaattgcttcttttgttccaaagaaggttgcccaacaatgggtcattttgctgatagatttcacttcaaaaatatgaagactaatggatcacattattttttaaacacagggtccctttccccatttgcccgttggaggcacaaattgtctgttaaactcagtggaagcgaagtcactcaaggaactgtctttcttcgtgtaggcggggcagttaggaaaactggggagtttgccattgtcagtggaaaacttgagccaggcatgacttacacaaaattaatcgatgcagatgttaacgttggaaacattacaagtgttcagttcatctggaaaaaacatttgtttgaagattctcagaataagttgggagcagaaatggtgataaatacatctgggaaatatggatataaatctaccttctgtagccaagacattatgggacctaatattctccagaacctgaaaccatgctaatctcagatacagtcttgatggatttctttagtaggagcaatgaagaaaagtgtctccttccacctggcatccagaccaaatttgacccttgtaaatgacttagtcatttacaagggtcttactcagagtcaagtacgggtttgctttttttctgtgtagaatgttcatctaactgcaccttaaaaacacactgaaccctgggacaaaagataattactatgatctgtaggaatctggatatcattgacaaaatagagctgttttggaattttcctgaataagaggaggtgatgcaaatgtatgttgagtgtataaactcactggacaaaagtaagcctctggcttgctgagtttttgaagtatattttcaggtataataatcattgttctaaaattatataaaactatttgttatgttgttaaatcttgctgagacaaattatgactatagtgcatgatatatagtagattataaccttgtgggttgatgtgtctatctagtaataataaaaactaatgagatggcactagtatttccaaggtgttccttggtgttcagggtgtgcacaagagagattttggagcttatctgttatgtgttcatcagttagcaatgggacctgaagttcaacaacccagggtatagcccccttcctccaaagtccctgccacaggagaattactcctctccctgggtcttgaatgctctatggtgaatttgtatttagcctcaaggcagcatttcatttgtaaagcacttgggtaaccctttgttcttgcaataacaatattataatatttaaa

SEQ ID NO: 720 - DNA, 1788 bp, Homo sapiens
ggaggtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcaaggatgatcgaacagagagctgtggacacatccttgtacatactgcccaaggaagacagggaaagtcttcagatggcagtaggcccattcctccacatcctagagagcaacctgctgaaagccgtggactctgccactgcccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggagcaggtgccgagaggttgccctgatgggctctgcccgctggacatgttcttgaatgccatgtcagtttataccttaagcccagaaaaataccacgcactctgctctcaaactcaggtgatggaagttggaaatgaagagtaactgatttataaaagcaggatgtgttgattttaaaataaagtgcctttatacaa

SEQ ID NO: 721 - DNA, 5036 bp, Homo sapiens
acatgtgggttctttcaaacatactggacttcctccttaggttttagttgtgttagtcaatagttgaatgttgaaggagaggatgccaagggatattaaagaagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttgacacttttatgttgtgagagctgagattcaccattctccaccatcctgagaagagctttgatagaagggctactcgtgagcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaatcaactggtaatttattcatttcatttggtaaaaatgtattgactgcctgctatgttctaggcaccatgctatgtatttggaatacagctatacaaagcattgtcacataattgaaatgaaaattttatattatttaagtcacaagaacaagctatttaattatattacttttagtttctcttttaataaagaatagataatgctatcattctagatactaaataagtattttcttaacataatattactatccactttatcttgtagaagaaataactaaaatacatctgtcttcactcctgtatttgtttgcattttaaggattaaagacagaaatagaaatgtaaacaactttattttgaaaatatttcaacactgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtgtgtgggaggggagattagcatgaggggtgggaatggggagattcgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtgtgtgtgtgtgtgtgtgtatggcgttgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcatatgtcccaggtggagttcagaaaatattctcttcatttccacaaaggggaatagtgcctggagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgttcattgtctgtcttttccaaattctactgcctcttaccctctccagaatgaaaactagtatctttgtttttgtttactgatgtaacccaaacacctacaaacagtgcccagtatatactaggcccacaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattattgtaggactcaagagggaattaaaactacaaaaatgactcctcttgtatgacacagaaagaaatgtttcttcacagagggaggagaaaaatatcttcaagagagaactaatagaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcaca

SEQ ID NO: 722 - DNA, 2713 bp, Homo sapiens
atggtgacgaaggcctttgtcttgttggccatctttgcagaagcctctgcaaaatcgtgtgctccaaataaagcagatgtcattcttgtgttttgctatcccaaaaccatcatcaccaaaatccccgagtgtccctatggatgggaagttcatcagctggccctcggagggctgtgttacaatggggtccacgaaggaggttactaccaatttgtgatcccagatttatcacctaaaaacaagtcctattgtggaacccagtctgagtacaagccacctatctatcacttctacagtcacatcgtttccaatgacaccacagtgattgtaaaaaaccagcctgtcaactactccttctcctgcacctaccactccacctacttggtgaaccaggctgcctttgaccagagagtggccactgttcacgtgaagaacgggagcatgggcacatttgagagccaactgtctctcaacttctacactaatgccaagttctccatcaagaaagaagctccctttgtcctggaggcatccgaaatcggttcagatctgtttgcaggagtggaagccaaagggttaagcattaggtttaaagtggtcttgaacagctgttgggccaccccctcggctgacttcatgtatcccttgcagtggcagctgatcaacaagggctgccccacggatgaaaccgtcctcgtgcatgagaatgggagagatcacagggcaaccttccaattcaatgctttccggttccagaacatccccaaactctccaaggtgtggttacactgtgagacgttcatctgcgacagtgagaaactctcctgcccagtgacctgcgataaacggaagcgcctcctgcgagaccagaccgggggagtcctggtcgtggagctctccctgcggagcaggggattttccagtctctatagcttctcagatgttctccaccacctcatcatgatgttggggatttgtgccgtgttataggagttagccaggcagctgccgctcctccacccacaatagtcctcagcgaatgacaaacacatttattgtgctgccaaaaagaacaaacagaagaccacattgttggggggcagagaatagcactttgccaaatatgcactccaataatttctgtgaatttggtgatgcctttttctttctaagaaaaacttaggctacttcccgtggcccttagatctcacagtccttctacagctgggggaggagcctcctttctccatactcaagtcagggctgcagtaaattcctttgaaagctattttaactttaaaaggttagcagacccaaccaagtactgctgagcattttgaagagaatgtagggtgcaactacaaagtcaacactaaatgcacaacgcacattaatagctgactttgccaaaaaggagctttgtcattgaggcagtgtcattctacttaaggaccagagctgagcccccacgcagggagttccaatctttcaactgatgacatgggagatgatgtgggattcagagtggaatacaatagttttgctcaaacctaatgatataaaggaaatagattcttgaaagcccctagtactgacctaatttgtttttattataccatttgttaaatatataaacatgatataggtagaaactccttgtttttatagcagatgtatacttctaaagtcaaaagaaaattacaaattaaataggaatatttacaaaaagaataatcacaagaagaatacaactcacattaatttaacctaataacacggcattgccccagtgaaactgctgctggaaacatgactataaagtgactccaatgacacaagtgctgtgagtttggtgacccaatcctacagataaatgccttgtgacactcaatgctattttttctctatttgctctactaagaagttttcatttataagaaatggtctgatctcatttagcttttacttaaacatcgaagcttacatctgtttttgtctcattcacttacaatcattagaatgaagctaacacaaaatcagaaacacaaatgcaaatgcagccaatgaaagcatgcagtagcacatcttggtaactggccaccccagtgatccagaatatgcccatataaatgatttacattgtcaacaaaatacaaactgaatgaaccaattctggtagagaattggctggattgtgataggaaaaggcagagttctaagtccttagttatgtaaagacttaattagtaggcttataatttgaaaacaacacatgggtttgtctctctgtatttaaggtatttgagaagttttgcaatttgcagtttgatgattcttttacaacttgtgttagtgaactcagagattaaactagttatgaaatctccggatacatgaagtgtatgtttgtttagtaataggctaaagtaaaatgactcaatttggtctagacttggtctctaagctggagttccaacgagtttaggatctcttctttctgtaaattcagagtttttatagtcaggaaaaacagaagacatattttattggttctagtagaaaactcttaaatagcatactcatagccatgttcaaatcctttgctgtcagaataaaccaatgttgtattagttttgctgtatttcatcattgtgttttatgatcttgtatctctacctggcgctatggaataaataaaatgccttaaaataaa

SEQ ID NO: 723 - DNA, 1934 bp, Homo sapiens
aaagctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggttgagatccgtagcattttagtgtccgagaggataattgctaagggagcagagacctcttcacaccttcatgcgcttagacctgcctagaggctcagatggctcagtggcactgctcacagagaacacaggctggaggacatggagtcggggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccactgctc

SEQ ID NO: 724 - DNA, 1282 bp, Homo sapiens
gtccctgccctggcacctgagaacagcttcagaattgggctgaacttcagtgcccagcccacccccttgccctctcccaggttctccttcaccccctgcagagccatcggctccctctatcctttgcaaccccctatgaatctttcctacttgtccaggtggagtgagtctgaggacagcagatgaacagacagaaactgaaagatccccaaaaaggatgagtgagagggtcgagcggaactggagcacgggcggctggctgctggcactgtgcctggcctggctgtggacccacctgaccttggctgccttgcagcctcccactgccacagtgcttgtgcagcagggcacctgcgaggtgattgcggctcaccgctgctgcaaccggaaccgcatcgaggagcgctcccagacggtgaaatgctcctgtttttctggccaggtggccggcaccacgcgggcaaagccctcctgcgtggacgacctgctcttggctgcccactgtgctcgtagagaccctagagctgcactccgcctcctgctcccacagcctccatcgtcctgcagagatggtggtgtcagatggagccctgcctgccgggggaggagtgtaaggtgctcccggacctgtcgggatggagctgcagcagtggacacaaagtcaaaaccaccaaggtcacacgatagctcttgggggtcacggcctggacaagaaaggcttgactgagccgtgaactgaagaatggtatccagtcatcagccaggaaagatggggattcacttacatgcctcatgtcaaatgcagcatcagtctttccggggcatttcagttaagctgctcagcagatatggatggatctgcaatcacatacctaatgtggagctgggcttttctggagacacgaaggtcaacacacaattcctgcccttaaggaatgtccagttgaattggagagttgatgacagacaatttagataatttaggttaaagtacttgataccagactgcggcttctgggccacatgctatggcatgatgggggtttgggaatgagattcccacagttcttcagataccctgtggccacagggcatagaaacaagaggtcacattcagcacccaccacctccctctttcgcatcagttctgaatccccagcaagctgttaacatgttgcaggaaaacactctccccttatgccagaccagcagtatctcatttggatgggattggattgacttgcggaaggaaagtaaaaataaagccaaataacttcccaaa

SEQ ID NO: 725 - DNA, 1521 bp, Homo sapiens
agagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaa

SEQ ID NO: 726 - DNA, 3818 bp, Homo sapiens
gagcaggtgggggtgcagcgcggtggcgcgcgggagccccgaggggcggaggcggctgctacacctagggcgtcgcggagcgccccgggcttggcgcgggcggagccgccctaagggccgcgcgtgtccccggcctcggccccgccccgtcccgtccaatgagagcccgcggccgaaggggctgtccgcacactaggcccgcagctcccttcagcgccgcagaccccctgacaccgcacccggtcctcaggcagcgcgccccagaccccgggttcggcacgccgtcgtcggcttccggacatcgcaacttgcgcccctctcggggatcctcctcccgggctctggaccccaggtgatcctaggtccccagccgccggcgaacaccatggccccccaggggggtgaggtaggagcagcctgagtacccccagaaggtgccccgtccacgcccctccgggctgcgcggcgggagtcttcggggagctatgctgagaccgggtggtgcggaggaagctgcgcagctcccgcttcggcgcgccagcgccccggtccctgtgccgtcgcccgcggcccccgacggctcccgggcttcggcccgcctaggtcttgcctgccttctgctcctgctgctgctgacgctgccggcccgcgtagacacgtcctggtggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccaaacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgagcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgtagtaagtctggctaggccttgtgttgccttttttttttttttttttttcttttcttttcttctcttcccatgcactattctggaggtttgccaggtttggggagacatggagtaaaagaaagataggcaactcatggatggtgggagagcaggtaagcaggtctgatctcaagggcccacatgaggcatcagtatatattaggcaggtagggatctctggctttggtaattctttatgagaggatcctagcctttgaagctgggagcaggagtcagtggctacagtgggaaggagtactgcaggttggggccaaagtgatacacagcttagaaggcagccttcctccacttactcaacaaatctttatttagtgactctccaagtcctagtgattattattattgttcactccacatttggcttaatgggtaatgctattacccattgcctaactaggtttgcagtagtggaatctccagagatagcaggcttagtaagctggaggtaggacatgaagtcccccaaaacttgatgtcctatttttatgtgagttggacagtggttatcttttgcctgttgatatcttaaagcagcagagtggtatagaaatttgcggttatgacagacccgggttaaaaatcacagctgtgccatttgctttgatattttgagcaaggtagctaaattttctgagcttctattttctcatctgtaaaatgaggatacgtacctgttcttttttttctttctttttatttcttttagagatagggtctcgctttgttgcccaggctggagtgcactggcatgatcatggctcactgcagcctcaaattcccaggctcaagcaatcctcccacctcagcctccccattagctgggactacagggccatgccatcatgcccagctaatttaaacatagttttcagagatggagctcactatgttgcccaggctggtcttgaattcttggtctcaagcaatcctcccactgcagccttccaaagtgctgggcgtacaagcgcaagccactgtgcccagctgtcagacgctgagttttaattatgcaccaaactccagcccgcagatcctcttcaccaaagcccctggctggtctagcccatcatgacttctctaggaacagtccttctttaggactataaagtattaacaaaagtctgtagattaaggagcctgcataaagaattctggatacaggcccctgtctttccaaagttcctctccaatatcccttggggtcctcatgtttttgaagcagcttcactctgcacaggcagcaggaggttgggggagccatagctctgggccacgggggcagatttatttggatgataggactaatatttgtgtaacctgctg

SEQ ID NO: 727 - DNA, 1997 bp, Homo sapiens
aagcaatgtggttgtaaaatttgcaaaataagattaaatcttaactgcaatctgttaacactgctgtctcctttcactctttctcctatatcacactttcccacatgttggatggccttggagtggtagccataagcatttttggaattcaactaaaaactgaaggatccttgaggacggcagtacctggcatacctacacagtcagcgttcaacaagtgtttgcaaaggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccaaacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgagcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgt

SEQ ID NO: 728 - DNA, 2440 bp, Homo sapiens
tctcagtggcgagctctgggtgctgtggcccggccttggcggggcggcctccggctcaggctggctgagaggctcccagctgcagcgtccccgcccgcctcctcgggagctctgatctcagctgacagtgccctcggggaccaaacaagcctggcaggacaaaattagaagatcaaaatggaaaatatgctgctttggttgatatttttcacccctgggtggaccctcattgatggatctgaaatggaatgggattttatgtggcacttgagaaaggtaccccggattgtcagtgaaaggactttccatctcaccagccccgcatttgaggcagatgctaagatgatggtaaatacagtgtgtggcatcgaatgccagaaagaactcccaactcccagcctttctgaattggaggattatctttcctatgagactgtctttgagaatggcacccgaaccttaaccagggtgaaagttcaagatttggttcttgagccgactcaaaatatcaccacaaagggagtatctgttaggagaaagagacaggtgtatggcaccgacagcaggttcagcatcttggacaaaaggttcttaaccaatttccctttcagcacagctgtgaagctttccacgggctgtagtggcattctcatttcccctcagcatgttctaactgctgcccactgtgttcatgatggaaaggactatgtcaaagggagtaaaaagctaagggtagggttgttgaagatgaggaataaaagtggaggcaagaaacgtcgaggttctaagaggagcaggagagaagctagtggtggtgaccaaagagagggtaccagagagcatctgcgggagagagcgaagggtgggagaagaagaaaaaaatctggccggggtcagaggattgccgaagggaggccttcctttcagtggacccgggtcaagaatacccacattccgaagggctgggcacgaggaggcatgggggacgctaccttggactatgactatgctcttctggagctgaagcgtgctcacaaaaagaaatacatggaacttggaatcagcccaacgatcaagaaaatgcctggtggaatgatccacttctcaggatttgataacgatagggctgatcagttggtctatcggttttgcagtgtgtccgacgaatccaatgatctcctttaccaatactgcgatgctgagtcgggctccaccggttcgggggtctatctgcgtctgaaagatccagacaaaaagaattggaagcgcaaaatcattgcggtctactcagggcaccagtgggtggatgtccacggggttcagaaggactacaacgttgctgttcgcatcactcccctaaaatacgcccagatttgcctctggattcacgggaacgatgccaattgtgcttacggctaacagagacctgaaacagggcggtgtatcatctaaatcacagagaaaaccagctctgcttaccgtagtgagatcacttcataggttatgcctggacttgaactctgtcaatagcatttcaacatttttcaaaatcaggagattttcgtccatttaaaaaatgtataggtgcagatattgaaactaggtgggcacttcaatgccaagtatatactcttctttacatggtgatgagtttcatttgtagaaaaattttgttgccttcttaaaaattagacacactttaaaccttcaaacaggtattataaataacatgtgactccttaatggacttattctcagggtcctactctaagaagaatctaataggatgctggttgtgtattaaatgtgaaattgcatagataaaggtagatggtaaagcaattagtatcagaatagagacagaaagttacaacacagtttgtactactctgagatggatccattcagctcatgccctcaatgtttatattgtgttatctgttgggtctgggacatttagtttagtttttttgaagaattacaaatcagaagaaaaagcaagcattataaacaaaactaataactgttttactgctttaagaaataacaattacaatgtgtattatttaaaaatgggagaaatagtttgttctatgaaataaacctagtttagaaatagggaagctgagacattttaagatctcaagtttttatttaactaatactcaaaatatggacttttcatgtatgcatagggaagacacttcacaaattatgaatgatcatgtgttgaaagccacattattttatgctatacattctatgtatgaggtgctacatttttaggacaaagaattctgtaatctttttcaagaaagagtctttttctccttgacaaaatccagcttttgtatgaggactatagggtgaattctctgattagtaattttagatatgtcctttcctaaaaatgaataaaatttatgaatatgacttaaaa

SEQ ID NO: 729 - DNA, 1489 bp, Homo sapiens
cacaagtctgccaggggaagtccctggacttcttgcttctttcgtgtaggacaggctgtcgaaacctcagtggataaaagacctagagaatgtgtatcccagaagaagctggccaaggatatgggagcaaccaccatggaccagaagtctctctgggcaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcaacaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgctccagtaa

SEQ ID NO: 730 - DNA, 1468 bp, Homo sapiens
gacaggctgtcgaaacctcagtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcaacaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgctccagt

SEQ ID NO: 731 - DNA, 3332 bp, Homo sapiens
tgctttgaaaccaaggttacagtagctttttggcccgcttgccgtggctttctccaactctcttcttcttttcagtctttgcaatacctgtccctgccggtctccaagtgcccctggttacaggtcagctccacactgaaggggaggagctacttcctagggtctcttcccagcatcacagccctacatcccagcgaccaacggtgttatactcctgggggccaaagaggacccggattgctttgttttgtgccatgtgagtactatgtccaacaggatggctggtggacgagagacatgtttgcctttgattggattcattcttatctgtcttaaaatggttgcttcagcaaaatcagctcctgaaatacccactattgatcaggcatattcaaaactcagcaacagtatcactgtagaatgggctacagtgccgggtgccaccagttacctcctcacggctgaagacggggacacagtcattgaaaccacggtggccaattccccaggcactgtgacgggactaaaggctgcaacctggtatgaaatcaccatcagatccatcagcgctgctgggagaagccaggcgtcacctccaaagcaggcaaagacagtgttggctgcaccaattctagaagtaagctctccaagttcagactccattcttgtgcagtgggaagctgtatatatggcaattgcattctccgtgtccattatgcgagccaatggcttggggagtatatggaaagagaatactacaaacacctccttgacattcaccagtttagaagccggaactctctacaccataaaggcctatgcatggaatgccaacagaatccctggggatgactccacctgcaatcagagaacaagtcctcgggcccctgccaacattcaagtctctttcgatagtggagctctgaaggcatctttttcctgggcacgggcagaaggagctttcaattatactgtgatggctttgagcgactcttcagagctgacctgcagtacaactttcagttcctgcaccatctcttccctccagtgtggaactgaatacttgatttcagttttagcaagtaatgatgctggatctagcaaatcatcttcagcaatgaccctgaaaactgttgcttgtgcacccggaagagtgacgatccaagaagatccccctggccacctgtctgtggcttggtccagtgtagatctgggtgactactatgtggtctttgtgaagagtgatgatggcttggaagtacactgcaacacatctctcactcagtgcaacttcttatctgagtgtggcttcacttattttattagtgtttttgtctataacaaggcagggcaaagtcctttgggtgacatattcaattataccacagctccctgttgtcctagtgacattaaccccgtgttggtgtccagtgacagagttgagattgtctggtctcctgtccgtggtgccgaactgtatgaaaccaaggctgtagatgggtacaacatggttgagtgcaatgacactactcctgcgtgcaccctttcggctctagagtgtgacaccaagtacaacatcacagtgtattcattcaatgaagtccgaggcagcaatatgtcatgtactccccagttcataaccacagctccttgcagtcctgaaataaaaaatgtttcaagggatgcattctccatgattaatgtgcactggcgatccactaatgatgatgctacttacacggtgactgcccaaggggagaaaggactgtatcagtgcagcagcacaggagagtcctgcaccatgcggggcttgccctgtggctcagtgttctctgtcactgctgtggccgaaacacaggcaggacggagcctgcccagctacagtgtgcccctggaaacagtgccatgctgtccaaccggtctgacagtaactcaaatcacccagtcagtaatcaacgtgagctggactattgggagagtggctcaaacccatgttgcagttctggagtcacacactggacagtctaagtgtcacactcatcaaaaccactgcctcctaggatgcatcacatgtggcatcaattacacagtgacattaaaagcaattagtgccaccgggttgactgcagattgctcctaccaaagttatttctctggtgcctgctgccctttgggggtgaaattatataggctgggccctaatggcatccggatctactggcaagcctccaggggctctgccaattacagcactgacctctatggctccaaaggcattttcacgtgcaccccgagtgctggcctcagtttctgtgatgtcactgagataccctgtggggatgtatacactgtgatggtctcaccagttgctaaaacaggattgaagcttactttctgtccaaaaaaaatatattcagtaacttgctctggaagtacacttggaatggtgatttatagagggaagagaaatgaagaatgacaaagtgagccccagataaaaacaaaaacttgaccaaagttgtctcatttgttagtgattagagatggaaaagatctactagaatgtagaataaaaatgcctctaggataggaaaagctcctttggcctttagaagaacaactctgactctgcttcctgagggcaaggtcaggtgtgtcctcacctgcacagcagttggagatctgctatgtgaggactctggagagaaatgaatccagaaagtcccctggacggctgctagcctgagttggcacactgtgagaaccctggaaacaagaaagttctgcttagcagaaattctgagatttcacatccacacacaccacagacttcaacacatccacttcatgagtgttttacaacagcacttgtctgcagccccctcaggggctggaaatgttcactcccagaaagtcaagccacccacatgcagacagcacttatcccaagacaaacctccagcaggacttcagtataggttggaaagcagtagctgccagggcaacctgagataacaaacgccctcatcgcaagttaggagcaaagctgagctgcttgcagggttcgctgagccaaagcatcaggtggcgtgacatctatgggagcatctgggaaagcagagctgccagcctgttgctagaagggttgcagttatgctttctgcatgagagaagatgtcaaatggagagcctcaaactgtggccgactgacatgcgtgcatcttttgggggaggaccatccatcttattggccatatcccccactcatattgtaattacttttttcatctttggagggggaaggcaatgaaatataacataaatctctcata

SEQ ID NO: 732 - DNA, 923 bp, Homo sapiens
ctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaagg

SEQ ID NO: 733 - DNA, 2351 bp, Homo sapiens
ggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaagcaacgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 734 - DNA, 3255 bp, Homo sapiens
tcctagctctgagaatgcctgcggaatgatcgccccccagggcggctgccgccgctgccgctgctgctgttattgctactgctgctgccgccgcctctgcttccactcggctctgactggcaggcagaaagtgcaactgacgagggaaaggtctctgcagtgagtggagagcctacataaaagagagtaaagaggggcaaaaacccagatcagaatgcaggcgacgtccaaccttctcaacctcctgctgctgtctttgtttgccggattagatccttccaagactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaacatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaaccagacacctgacatagagtctttattttaccccaagttttttgggccactgacattgaatgcaacaactgatttcatacaactgagttactctgttcactccactgaatgcaacccatatagtttcttgcacaaggtgcatctggattccaaatattggatttgagttgactctactcatttattatacactaaagaaattttgttcttcatagttaaatgtactagcatttaatttatattttacatacaacttgcaataatgaaattccttatgtcaggaccctgaaaataagcacatttgaaaactcttagaaaaaaaaaattctgtaatgtcctctagatttagattatgagccctgaggagttattggcaagatttgtgcaaaataaaatatggggagacttgggagttgtctttgtggtttcaaaagtgtaaataaccaattcagaaaacaaaatggaaaaacgaccccttgttaccttgattcactgtatgtggaaaaataatgtaaccaaaagggaagagctttaataatacttatgttaataactctatgaaacatataagctaactatatatcaaacatttcattgagtttggatgtattttccacatattaaaaaaatagttccctaaggcagctttatggaaactaatataggttggttttacaatttaaaaagtatattctataataaataataaaacaaattgttttaaatgtttagtttcacacatacatagtaccatgattttctttgaaagataaggatgtaatgatttagataaagcatcatgtaaagaaatcctaacatttaagtgtaattcatttcaaatgtcacaagtaaagcatcatcctcaaatatctcactgtcaaaattgtagaattaaataacccaatcttgaaa

SEQ ID NO: 735 - DNA, 1913 bp, Homo sapiens
ggctgggggaaatgacccgggagggtcccatgcggctacataaaattggcagccttagaactagtgggaaggcgggtgcgcgaagtcgaggggcggagagagggggccggaggagctgctttctgaatccaagttcgtgggctctctcagaagtcctcaggacggagcagaggtggccggcgggcccggctgactgcgcctctgctttctttccataaccttttctttcggactcgaatcacggctgctgcgaagggtctagttccggacactagggtgcccgaacgcgctgatgccccgagtgctcgcagggcttcccgctaaccatgctgccgccgccgcggcccgcagctgccttggcgctgcctgtgctcctgctactgctggtggtgctgacgccgcccccgaccggcgcaaggccatccccaggcccagattacctgcggcgcggctggatgcggctgctagcggagggcgagggctgcgctccctgccggccagaagagtgcgccgcgccgcggggctgcctggcgggcagggtgcgcgacgcgtgcggctgctgctgggaatgcgccaacctcgagggccagctctgcgacctggaccccagtgctcacttctacgggcactgcggcgagcagcttgagtgccggctggacacaggcggcgacctgagccgcggagaggtgccggaacctctgtgtgcctgtcgttcgcagagtccgctctgcgggtccgacggtcacacctactcccagatctgccgcctgcaggaggcggcccgcgctcggcccgatgccaacctcactgtggcacacccggggccctgcgaatcggggccccagatcgtgtcacatccatatgacacttggaatgtgacagggcaggatgtgatctttggctgtgaagtgtttgcctaccccatggcctccatcgagtggaggaaggatggcttggacatccagctgccaggggatgacccccacatctctgtgcagtttaggggtggaccccagaggtttgaggtgactggctggctgcagatccaggctgtgcgtcccagtgatgagggcacttaccgctgccttggccgcaatgccctgggtcaagtggaggcccctgctagcttgacagtgctcacacctgaccagctgaactctacaggcatcccccagctgcgatcactaaacctggttcctgaggaggaggctgagagtgaagagaatgacgattactactaggtccagagctctggcccatgggggtgggtgagcggctatagtgttcatccctgctcttgaaaagacctggaaaggggagcagggtcccttcatcgactgctttcatgctgtcagtagggatgatcatgggaggcctatttgactccaaggtagcagtgtggtaggatagagacaaaagctggaggagggtagggagagaagctgagaccaggaccggtggggtacaaaggggcccatgcaggagatgccctggccagtaggacctccaacaggttgtttcccaggctggggtgggggcctgagcagacacagaggtgcaggcaccaggattctccacttcttccagccctgctgggccacagttctaactgcccttcctcccaggccctggttcttgctatttcctggtccccaacgtttatctagcttgtttgccctttccccaaactcatcttccagaacttttccctctctcctaagccccagttgcacctactaactgcagtcccttttgctgtctgccgtcttttgtacaagagagagaacagcggagcatgacttagttcagtgcagagagataggtgaggccagctcgagatcttataccactctgtattggacaaaggctagcacagggctaggcaccaataaagatttctaatgatgcacaga

SEQ ID NO: 736 - DNA, 1196 bp, Homo sapiens
gcggaggctcggggagtcggcgccatgaccccatcgaggcttccctggttgcttagctgggtctcggccacggcgtggagagcggcaagatcaccccttctgtgtcattctctgaggaaaacaagttcttctcaaggaggaaagtctgaacttgtcaaacagtcccttaagaagccgaagttaccagaaggtcgttttgatgcaccagaggattcccatttagagaaagaaccactggaaaaatttccagatgatgttaatccagtgaccaaagaaaaaggtggacccaggggcccagaacctacccgatatggagattgggaacgaaaaggacgctgtattgatttttaagtcgcatattctttaacttcaatattgttttctgaatatgtacatctgaattaacttatttctgattattttctttctttatatcctttatgtcgtgtagtttgtataatgtgtttaaatatatatatatatgatggctttggaagaaaatatgctgctgtaaattaggaaagggagaccagcctgaccaatatggagaaatctcgcctttactaaaaatacaaaattagccaggcgtggtggcatgcacctgtaatcccaactactctggaggctgaggcaggagaatggcttaaacccaggaggtggaggttgcggtgagctgaggtcgcgccattgcactccagcctgggcaacaagagcgaaactccgtctcaaaaaaaaagataggaaagggaaaatattttttcattaacatatattaatttaatgagtatagaaatgattcttgtttttttgagacagagtctctctctctcacccaggctggagtggagtggcactatcccaactcactgcaacttccgccccgccaggttcaagcaattctcctgcctcagcctcctgagtagctgggattacagacacccaccattgcgcctggctaatttttgtatttttagtaaagacaaggtttcaccatgttagccaggctggtctcgaactcctgacctcagttgatccacctgcctcagcctcccaaagtgctgggattgcaggtgtgagccaccacgcccagcctagaaatgattcttagagctgtaggcctttacttcatcatttttcagtttaaattaatcagttgcttataaaatgcatacataaataaaataatttttaaaaaa

SEQ ID NO: 737 - DNA, 1974 bp, Homo sapiens
ccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcacgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgaaacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaa

SEQ ID NO: 738 - DNA, 3211 bp, Homo sapiens
gaacaaaccaacatttgagccaggaataactagagaggaacaatggggttattcagaggttttgttttcctcttagttctgtgcctgctgcaccagtcaaatacttccttcattaagctgaataataatggctttgaagatattgtcattgttatagatcctagtgtgccagaagatgaaaaaataattgaacaaatagaggatatggtgactacagcttctacgtacctgtttgaagccacagaaaaaagattttttttcaaaaatgtatctatattaattcctgagaattggaaggaaaatcctcagtacaaaaggccaaaacatgaaaaccataaacatgctgatgttatagttgcaccacctacactcccaggtagagatgaaccatacaccaagcagttcacagaatgtggagagaaaggcgaatacattcacttcacccctgaccttctacttggaaaaaaacaaaatgaatatggaccaccaggcaaactgtttgtccatgagtgggctcacctccggtggggagtgtttgatgagtacaatgaagatcagcctttctaccgtgctaagtcaaaaaaaatcgaagcaacaaggtgttccgcaggtatctctggtagaaatagagtttataagtgtcaaggaggcagctgtcttagtagagcatgcagaattgattctacaacaaaactgtatggaaaagattgtcaattctttcctgataaagtacaaacagaaaaagcatccataatgtttatgcaaagtattgattctgttgttgaattttgtaacgaaaaaacccataatcaagaagctccaagcctacaaaacataaagtgcaattttagaagtacatgggaggtgattagcaattctgaggattttaaaaacaccatacccatggtgacaccacctcctccacctgtcttctcattgctgaagatcagtcaaagaattgtgtgcttagttcttgataagtctggaagcatggggggtaaggaccgcctaaatcgaatgaatcaagcagcaaaacatttcctgctgcagactgttgaaaatggatcctgggtggggatggttcactttgatagtactgccactattgtaaataagctaatccaaataaaaagcagtgatgaaagaaacacactcatggcaggattacctacatatcctctgggaggaacttccatctgctctggaattaaatatgcatttcaggtgattggagagctacattcccaactcgatggatccgaagtactgctgctgactgatggggaggataacactgcaagttcttgtattgatgaagtgaaacaaagtggggccattgttcattttattgctttgggaagagctgctgatgaagcagtaatagagatgagcaagataacaggaggaagtcatttttatgtttcagatgaagctcagaacaatggcctcattgatgcttttggggctcttacatcaggaaatactgatctctcccagaagtcccttcagctcgaaagtaagggattaacactgaatagtaatgcctggatgaacgacactgtcataattgatagtacagtgggaaaggacacgttctttctcatcacatggaacagtctgcctcccagtatttctctctgggatcccagtggaacaataatggaaaatttcacagtggatgcaacttccaaaatggcctatctcagtattccaggaactgcaaaggtgggcacttgggcatacaatcttcaagccaaagcgaacccagaaacattaactattacagtaacttctcgagcagcaaattcttctgtgcctccaatcacagtgaatgctaaaatgaataaggacgtaaacagtttccccagcccaatgattgtttacgcagaaattctacaaggatatgtacctgttcttggagccaatgtgactgctttcattgaatcacagaatggacatacagaagttttggaacttttggataatggtgcaggcgctgattctttcaagaatgatggagtctactccaggtattttacagcatatacagaaaatggcagatatagcttaaaagttcgggctcatggaggagcaaacactgccaggctaaaattacggcctccactgaatagagccgcgtacataccaggctgggtagtgaacggggaaattgaagcaaacccgccaagacctgaaattgatgaggatactcagaccaccttggaggatttcagccgaacagcatccggaggtgcatttgtggtatcacaagtcccaagccttcccttgcctgaccaatacccaccaagtcaaatcacagaccttgatgccacagttcatgaggataagattattcttacatggacagcaccaggagataattttgatgttggaaaagttcaacgttatatcataagaataagtgcaagtattcttgatctaagagacagttttgatgatgctcttcaagtaaatactactgatctgtcaccaaaggaggccaactccaaggaaagctttgcatttaaaccagaaaatatctcagaagaaaatgcaacccacatatttattgccattaaaagtatagataaaagcaatttgacatcaaaagtatccaacattgcacaagtaactttgtttatccctcaagcaaatcctgatgacattgatcctacacctactcctactcctactcctactcctgataaaagtcataattctggagttaatatttctacgctggtattgtctgtgattgggtctgttgtaattgttaactttattttaagtaccaccatttgaaccttaacgaagaaaaaaatcttcaagtagacctagaagagagttttaaaaaacaaaacaatgtaagtaaaggatatttctgaatcttaaaattcatcccatgtgtgatcataaactcataaaaataattttaagatgtcggaaaaggatactttgattaaataaaaacactcatggatatgtaaaaactgtcaagattaaaatttaatagtttcatttatttgttattttatttgtaagaaatagtgatgaacaaagatcctttttcatactgatacctggttgtatattatttgatgcaacagttttctgaaatgatatttcaaattgcatcaagaaattaaaatcatctatctgagtagtcaaaatacaagtaaaggagagcaaataaacaacatttggaaaaaaa

SEQ ID NO: 739 - DNA, 2294 bp, Homo sapiens
ctggctgccggctgctgccaccgcaatcccggctcctaaatcagcgcggggaggcgctccctccccacgcccggctctccgggctctcggggccgcgattggccgcgccggcgccccccaccccgggcccccggctccagctgccgcgccattggctgcgggcctccgccagcctttacataagaccgggcgcgctcgagtggagttgtataaagcgagcgcgcggcgtcggggcgggaggctcgaggccagcccgggaccggggctgggagcaagcaggcggcggcgccggcggcagaggcggcagcgagcgcccgcttcccacgcccctaggcggcggggccgagagcgggaggatggctccgagcgctgaccccggcatgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggctcaagtggcctttttaggtgggtattcttcagccgcctctagaatctctgagcctctctctcgggcctcatatctttctctaggccttggactttgccttcagttatatgcactttaa

SEQ ID NO: 740 - DNA, 2890 bp, Homo sapiens
ctggctgccggctgctgccaccgcaatcccggctcctaaatcagcgcggggaggcgctccctccccacgcccggctctccgggctctcggggccgcgattggccgcgccggcgccccccaccccgggcccccggctccagctgccgcgccattggctgcgggcctccgccagcctttacataagaccgggcgcgctcgagtggagttgtataaagcgagcgcgcggcgtcggggcgggaggctcgaggccagcccgggaccggggctgggagcaagcaggcggcggcgccggcggcagaggcggcagcgagcgcccgcttcccacgcccctaggcggcggggccgagagcgggaggatggctccgagcgctgaccccggcatgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtagatggagatctcaatctggggtcggtggttaaggagagctgcgagcccagctgctgagcaggggtgggacatgaaccagcggatggagtccagcaggggagtgggaaagtgggcttgtgctgctgcctagacagtagggatgtaaaggcctgggagctagaccctccccaagcccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtga

SEQ ID NO: 741 - DNA, 1695 bp, Homo sapiens
gggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacagctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctccacactggccccgtcacctgtccacacacgacaggcacacacagctcccactgcagggcctttgctgttgctgtgcctcactccaggaatgaccttgaagccatgtttgaagaggaagtacccaggattttttactcagcttgaacgtttacgagggtagcttgtggggtccgattatgatattgggaatggcatacaacccccctccccaaacctcctggatgttttcactgtcctcctgaacccacccatgtctacatgtgtttttttgaacttttgtttttttaaaaaacctatacatggaattcatgctcaatgcagaaaactttgaaaatgctaaagtataaaaaaaaaatgcttgaa

SEQ ID NO: 742 - DNA, 7859 bp, Homo sapiens
gggagagggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctggacttgagtgagaacgccatccaggccatccccaggaaagcttttcggggagctacggaccttaaaaatttacagctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatagcgctgggcgtggacaggccggtgagggcgggcaaggggccccagccgctgcagcagcggagacagtcgccagcagctgggctggggtgcaggtcatcacaggacggctcctgggcagctgggccctcctgggtggggtggtgccagagcagccttttaaaagcaaattgcgccatagctgggggcagcgggggtgggcgaggcctgagctgcgggctgccctctccggaagtgccttgcacaaataggcgcttaataaatatttgttgagtgaatgtgtgcgtgaggtcaggccaagaagtgcagaacgatgacacccctccttacctgctatctgaatctggagaagaaaaatgacagccttccaaaccaacccttccctttggcctgtggcccaggctggcttggaactgggtctgtggccccagaagcctcttacccctctgcgggcaaccatgaagtactgtcagcctccccgggaagccagcctggttcattctgctgctacagaatctgctggtggtaggccaggctctggagcgggggtgccgcctcctgctggccagggagggtcggacccttgccccctgggctgactggcagctctgcagccacggcttgggaacgaggctgtgggtggaggtggttcttaggaccaggcctctgaatcctaaagttctagcatgactactgtagctgcgagggcttatgtggaggaaacagtcacaggggctgctcagggtggcagaccccactaaagagggcagagggttctttgctctagataaacaaacatcatctgcctccagacactggccacagtaggagtattggtcctgggcttccccagccaccagtcagccacaagctgtcggtgacctattggtagagggactgggtgtgagggtctgggccagggtgcttgacctgggagcagctggttcagagtccttcacaccgcaggccagtagggagcagtggaagggacagtgctccaggcattgggaagtccctgctggctctatcactcggggcaaacttctccccacctgggccttgggttcttcagctataaaatggccagaggtggggggcgggatgactaaaggaacagtgcagactcccccactgtggtcttgggaggccagaggagttagaagacctatctatctatctatctatctacattgatcacatcaaaagtatttatgtgcctaacccggggctggggattgtggacgttctggcctaatggacagatgtgaactcatcccagagcatcgcaggaatgaccaggatgcccgggaagagttgagctgagtgggggctccagccacagacagcggcccaggccagggagttgctggcaacgaaggagccagtggtggaagaagaagaggccctgaatatacgattgcctgcccacgttgtcttctcttccatacacagtgaaaatgtagaaagatggtttgtgaggccaaactgtgaatgggctaaagggaggcaaagttgcactctccttccccagagggctcaccaagagggcacacccccgggggttctggtgggcaacgggggtgagcatgtccctgccctggctccctccatctgtgaccaggaggcatggctgggtgtatgttcaggtgaggctcagagtggcattgtgtccctgtcccctgcccagggcagtgaggggagcccttgatgctgattagaaggctagaactggggtagaggtgcctggcatgtctcatgccatggggactcaatctagcaactgtgagtcctggggtccctgtgatgggaagagggcagtgccctgcccaatgtggcaggtgtcctcatggcaggatctgcccctcaccagggggctgggatctacttgcttggagctctgagcaaggccacaatgcccgcccccacccccaagtagactgcagcctgggcctcatggggcttctcccaggcccacatggcatccctctctgagtttccaggccaccgtgggaccctgcagagcatctgcaccgggctggatagggcagaaaagctcaagggcagctagcttgcctcttccctggaagaaaggtgctctgggactcaccaaccctgagaaagatagctttcctggccaccaccattccccaccaccctggagaagccaattcccaggcttgaagggcactggctggcaggaggcctcttcattctgcaggaggtggaaaggacacctgtagacaggtgatgctcacccctcacctggcgccatggggctgggaggtgagcggctggcatgtttgttcctagggagcaccatgtgagcttaaggctcccctgaccggccccaccacatggcccagcctcctagcacagcagcgctgacctcagtgcagtctgaggattggaatccaccatgagatgatgtgagagctgtgtgccccaggatcaactttttctccaacttggccatcagccagcgagttgctaaggacctgagtcagcactcacgttgcctattcacactccgcttgaaagtccggaaggtggctactgcaaaatcacccctctgagaagtcctctctccacatcttgtccccctttgtgaagacccctagttcgctctgcattttaggcatgaagagatacagcagggtgcgtccggagggagctgtggccttgcaacaccactggcaacagggccggggctcccggtgaaggtgtcaggaagtggaaaaggctggactttgtctcctctttgcctgctggtagcctaaccgcaaaagtatctctttatacagaatacttacagattctaatatatatttgtatttcattttgttacagtatttttatatgttaaagtcaacatccagcgtcttgttttgcctttcagatgctatgtggtcgtggcacgttttgttgggggtttctgtagtcgtcttgtttggatcaactcctagaggctggtttagaacaggcccatgagggagctgcacctgccctggaagtattgttttagactatgtcgatattgtctgttgtcttccatgtgaacatgacattgagtcactctgc

SEQ ID NO: 743 - DNA, 7889 bp, Homo sapiens
gggagagggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacagctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatatgccccctctccttctgctcaccttgcagagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatagcgctgggcgtggacaggccggtgagggcgggcaaggggccccagccgctgcagcagcggagacagtcgccagcagctgggctggggtgcaggtcatcacaggacggctcctgggcagctgggccctcctgggtggggtggtgccagagcagccttttaaaagcaaattgcgccatagctgggggcagcgggggtgggcgaggcctgagctgcgggctgccctctccggaagtgccttgcacaaataggcgcttaataaatatttgttgagtgaatgtgtgcgtgaggtcaggccaagaagtgcagaacgatgacacccctccttacctgctatctgaatctggagaagaaaaatgacagccttccaaaccaacccttccctttggcctgtggcccaggctggcttggaactgggtctgtggccccagaagcctcttacccctctgcgggcaaccatgaagtactgtcagcctccccgggaagccagcctggttcattctgctgctacagaatctgctggtggtaggccaggctctggagcgggggtgccgcctcctgctggccagggagggtcggacccttgccccctgggctgactggcagctctgcagccacggcttgggaacgaggctgtgggtggaggtggttcttaggaccaggcctctgaatcctaaagttctagcatgactactgtagctgcgagggcttatgtggaggaaacagtcacaggggctgctcagggtggcagaccccactaaagagggcagagggttctttgctctagataaacaaacatcatctgcctccagacactggccacagtaggagtattggtcctgggcttccccagccaccagtcagccacaagctgtcggtgacctattggtagagggactgggtgtgagggtctgggccagggtgcttgacctgggagcagctggttcagagtccttcacaccgcaggccagtagggagcagtggaagggacagtgctccaggcattgggaagtccctgctggctctatcactcggggcaaacttctccccacctgggccttgggttcttcagctataaaatggccagaggtggggggcgggatgactaaaggaacagtgcagactcccccactgtggtcttgggaggccagaggagttagaagacctatctatctatctatctatctacattgatcacatcaaaagtatttatgtgcctaacccggggctggggattgtggacgttctggcctaatggacagatgtgaactcatcccagagcatcgcaggaatgaccaggatgcccgggaagagttgagctgagtgggggctccagccacagacagcggcccaggccagggagttgctggcaacgaaggagccagtggtggaagaagaagaggccctgaatatacgattgcctgcccacgttgtcttctcttccatacacagtgaaaatgtagaaagatggtttgtgaggccaaactgtgaatgggctaaagggaggcaaagttgcactctccttccccagagggctcaccaagagggcacacccccgggggttctggtgggcaacgggggtgagcatgtccctgccctggctccctccatctgtgaccaggaggcatggctgggtgtatgttcaggtgaggctcagagtggcattgtgtccctgtcccctgcccagggcagtgaggggagcccttgatgctgattagaaggctagaactggggtagaggtgcctggcatgtctcatgccatggggactcaatctagcaactgtgagtcctggggtccctgtgatgggaagagggcagtgccctgcccaatgtggcaggtgtcctcatggcaggatctgcccctcaccagggggctgggatctacttgcttggagctctgagcaaggccacaatgcccgcccccacccccaagtagactgcagcctgggcctcatggggcttctcccaggcccacatggcatccctctctgagtttccaggccaccgtgggaccctgcagagcatctgcaccgggctggatagggcagaaaagctcaagggcagctagcttgcctcttccctggaagaaaggtgctctgggactcaccaaccctgagaaagatagctttcctggccaccaccattccccaccaccctggagaagccaattcccaggcttgaagggcactggctggcaggaggcctcttcattctgcaggaggtggaaaggacacctgtagacaggtgatgctcacccctcacctggcgccatggggctgggaggtgagcggctggcatgtttgttcctagggagcaccatgtgagcttaaggctcccctgaccggccccaccacatggcccagcctcctagcacagcagcgctgacctcagtgcagtctgaggattggaatccaccatgagatgatgtgagagctgtgtgccccaggatcaactttttctccaacttggccatcagccagcgagttgctaaggacctgagtcagcactcacgttgcctattcacactccgcttgaaagtccggaaggtggctactgcaaaatcacccctctgagaagtcctctctccacatcttgtccccctttgtgaagacccctagttcgctctgcattttaggcatgaagagatacagcagggtgcgtccggagggagctgtggccttgcaacaccactggcaacagggccggggctcccggtgaaggtgtcaggaagtggaaaaggctggactttgtctcctctttgcctgctggtagcctaaccgcaaaagtatctctttatacagaatacttacagattctaatatatatttgtatttcattttgttacagtatttttatatgttaaagtcaacatccagcgtcttgttttgcctttcagatgctatgtggtcgtggcacgttttgttgggggtttctgtagtcgtcttgtttggatcaactcctagaggctggtttagaacaggcccatgagggagctgcacctgccctggaagtattgttttagactatgtcgatattgtctgttgtcttccatgtgaacatgacattgagtcactctgc

SEQ ID NO: 744 - DNA, 4564 bp, Homo sapiens
ggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacagctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcata

SEQ ID NO: 745 - DNA, 665 bp, Homo sapiens
cccagagggagtggaaaggctttgaaagtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatga

SEQ ID NO: 746 - DNA, 2890 bp, Homo sapiens
gtacctgtagctgcggcgctgaggtcggaacgtctgcgtgtgtgcgggctggttttgtggcggctgctgctagagctggagcatttgccggtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgagacattccactgcccttctcccaaaaagatgtcttttcgaaaaatggatcccagctgtacaataggattttactgtcgaaatgttcaggacttcaaacgagcttctgaagaaatcaccaagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactgaagaccagaagatcagagaaggaaactttaatgctgtctagcctcctgctattaatgcaatcaaagaatacttttgcatatgtcttgataattaaatagtatttgttaactgtgatatgcatacacttatataagcagaattatgagttaaagtaatacttagcaatatgattttataatggctcctcattatgcttgctgttgaaccttttatgaggagtgaatataaagtattggttttccctcacaaatttaaagattatgttattaatactattataactgcatcaatcaagtcagataaaggcaactataaaatagtagtagtgtttgtttcctatctcaagggcgaaattttatgggaactcaatttattatgcagtttttaagtttaaaataccaagaaagatgtcactagattctcttctatgtgatttttgttttttatataaagcagtgtagtggtgtttagaagctgaggccacctgtaaggcaaatctgccttaagtgtattatgtgttacttaaaggcaaatttgtgatctaaaagtacaagagtgatttttgagctaggattataaaatacataataaagatgtgagaagataaaatgcttttgttttggttttaatgttgggattattttaatcctttcatttgaaaaatcagtgtctcaaatgaattctgttcatttataataaatgcatatattgctctgaaaacaatattaatttttttaagtggagctttcatgtttcagtgtagaaacgtgacttataaagacataaaattgtgtatcatctaaagtcattgatctcttccatcagaaaacctgtttgtttagagttgcatgtaaagctgaaagagagggtgggcggattgttttagtatacctgatgagaaaaatcaggtttgacatttctcagtgaagattacttactgagttgaaataaatagtctgaaatcta

SEQ ID NO: 747 - DNA, 12875 bp, Homo sapiens
gactgcttgcattaaaggacttcctcatcctttttttcatgaaactgagcttgcttaatcagagatggagcaaactgactgcaaaccctaccagcctctaccaaaagtcaagcatgaaatggatctagcttacaccagttcttctgatgagagtgaagatggaagaaaaccaagacagtcatacaactccagggagaccctgcacgagtataaccaggagctgaggatgaattacaatagccagagtagaaagaggaaagaagtagaaaaatctactcaagagatggaattctgtgaaacctctcacactctgtgctctggctaccaaacagacatgcacagcgtttctcggcatggctaccagctagagatgggatctgatgtggacacagagacagaaggtgctgcctcacctgaccatgcactaagaatgtggataaggggaatgaaatcagagcatagttcctgtttgtccagccgggccaactctgcattatccttgactgacactgaccatgaaaggaagtctgatggggaaaatggtttcaaattctctcctgtttgttgtgacatggaggctcaagctgggtctactcaagatgtgcagagcagcccacacaaccagttcaccttcagacccctcccaccgccacctccgcctcctcatgcctgcacctgtgccaggaagccaccccctgcagcggactctcttcagaggagatcaatgactacccgcagccagcccagcccagctgctccagctcccccaaccagcacgcaggattcagtccatctgcataacagctgggtcctgaacagcaacataccattggagaccaggcatttcctgttcaaacatggatctggttcctctgcgatcttcagtgcagccagtcagaactaccctctgacatccaataccgtgtactcgccccctcccaggcctcttcctcgaagcaccttttcccgacctgcctttacctttaacaaaccttacaggtgctgcaactggaagtgcacagcattgagcgccactgcaatcacagtgactttggccttgttactagcctatgtgattgcagtgcatttgttcggcctgacttggcagttgcaaccagttgaaggagagctgtatgcaaatggagttagcaaagggaacagggggaccgagtccatggacactacttactctccaattggaggaaaagtttctgataaatcagagaaaaaagtgtttcagaagggacgggcgatagacactggagaagttgacattggtgcacaggtcatgcagaccattccacctggtttattctggcgtttccagattactatccaccatccaatatatctgaagttcaatatttctttagccaaggactctctgctgggaatttatggcagaagaaacattccacctacacatactcagtttgattttgtaaaactaatggatggcaaacagctggtcaagcaggactccaagggctctgatgatacacagcactcccctcggaacctgatcttaacttcgcttcaggagacaggtttcatagagtatatggatcaaggaccttggtatctggcgttttacaatgatggaaaaaagatggagcaagtattcgtgttaactacagcaattgaaataatggatgactgttcaaccaattgcaatggaaatggagagtgtatctctggccattgtcattgtttcccaggattccttggacctgactgtgctagagattcctgccctgtgctgtgtggtgggaatggagaatacgagaaaggacactgtgtctgccggcatggctggaaggggccagagtgtgacgttccggaagaacaatgcattgatccaacatgctttggccacggcacctgcatcatgggagtctgcatctgtgtgccaggatacaaaggagaaatatgcgaggaagaggactgcctagacccaatgtgttccaaccatggcatctgtgtaaaaggagaatgtcactgttctactggctggggaggagttaactgtgaaacaccacttcctgtatgtcaagagcagtgctcaggacacggaacttttcttctggacgctggagtatgcagctgtgatcccaagtggacaggatctgactgctcaacagagctgtgtaccatggagtgtggtagccatggagtctgctcaagaggaatttgccagtgtgaagaaggctgggtaggaccaacatgtgaggaacgctcctgtcattctcattgtactgagcatggccaatgcaaagatggaaaatgtgagtgtagccctggatgggagggcgaccactgcacaattgctcactacttagatgctgtccgagatggctgcccagggctctgctttggaaatggacgatgtaccctggatcaaaatggttggcactgtgtgtgtcaggtgggttggagtgggacaggctgcaatgttgtcatggaaatgctttgtggagataacttggacaatgatggagatggtttaaccgactgtgtggatcctgactgttgtcaacaaagcaactgttatataagtcctctctgccagggctcaccagatcctcttgacctcattcagcaaagccaaactctcttctctcagcacacttcaagacttttttatgatcgaatcaaattcctcattggcaaggacagtactcatgtcattcctcctgaggtgtcatttgacagcaggcgtgcctgtgtgattcgaggccaagtggtggccatagatggaactcctctagtgggagtgaatgtcagtttcttgcaccacagtgattatgggtttaccatcagccggcaagatggaagctttgacctcgtggccatcggtggcatctctgtcatcttaatcttcgaccgatcccctttcctgcctgagaagagaacactctggttgccttggaatcagtttattgtggtagagaaagtcaccatgcagagagttgtatcagacccgccatcctgcgatatctccaactttatcagcccaaaccctattgtgcttccttcaccgctcacatcatttggagggtcctgtccagagaggggaactattgttcctgagctgcaggttgtacaggaggaaattcccattccctccagctttgtgaggctgagttacctgagcagccgcacccctgggtataaaaccctgctacggatccttctgacacattcaacgattcctgtaggcatgataaaagtacacctcacagtagctgtggaagggcgactcacacagaagtggtttcccgccgcaattaatcttgtctacacatttgcttggaacaagaccgacatctatggacagaaggtttggggcctggcagaggctttggtatctgtgggatatgaatatgaaacgtgccctgactttattctctgggagcaaaggacagtcgttttacaaggttttgagatggatgcttctaacctaggaggctggtctttgaataagcatcacattttgaatcctcaaagtggaatcatacataaagggaatggagaaaatatgttcatttcccagcagcccccagtcatatcaaccataatgggtaatggacaccaaaggagtgtagcctgcaccaactgcaatggcccagcccacaacaacaaactctttgctcctgtcgccttagcttctggccctgatggcagtgtgtatgttggcgacttcaattttgtaaggagaatatttccctcgggaaactccgttagtattttggaattaagcacaagtcctgctcacaaatactatctggctatggaccctgtgtctgaatcactctatctatcagacaccaatactcgcaaagtctacaagttgaaatctcttgtggagacgaaagatctgtccaagaattttgaagtggtggcaggaactggtgatcagtgccttccctttgaccagagtcattgtggagatggtgggagagcatcggaagcttcactgaatagccctcgaggcatcacagttgataggcatggatttatttactttgtggatgggactatgattcgcaaaattgatgagaatgctgtgatcacaactgtaatcggctcaaatggtctgacttccacacaaccactgagctgtgactcaggaatggacatcactcaggtgcgattagagtggccaacagaccttgcagtaaatcctatggacaattcattgtatgtcttggataacaacattgtgctgcaaatttctgagaacaggcgtgttcggatcatcgcaggacgccccattcactgccaggtgccaggcatcgatcatttcctggtcagcaaggtagcaattcactccactctagagtcagcgagggccatcagtgtctcccacagcgggctgctcttcatagctgaaacagacgagaggaaagtaaaccgcattcagcaagtaaccaccaatggggagatctacatcatcgctggtgcccccactgactgtgactgcaaaattgatccaaactgtgactgtttttcaggtgatggtggctatgccaaagatgcaaagatgaaagccccttcctccttagcagtgtcgcctgatggaaccctctatgtggcagacctcggaaatgttcgaattcgtaccatcagcaggaaccaagcccacctgaatgacatgaacatttatgagattgcttcacccgctgatcaggaactgtaccagttcactgtaaatggaacccacctacacaccctgaacttgataacaagggactatgtttataacttcacctacaattctgaaggtgacttgggcgcgattaccagcagcaatggcaattcagtgcacattcgccgtgatgcaggcggaatgccgctatggcttgtggtgcctggcggacaagtatactggctgactataagcagcaatggagtcctgaaaagagtgtcagcccaaggctataatctggccttaatgacctatccaggaaacacagggcttctggctaccaaaagtaacgaaaatggatggacaaccgtttatgagtatgaccccgagggacacctgaccaatgcaacgtttcccactggagaggtcagcagcttccacagtgacctggagaagctgacaaaagtggagctagatacttccaaccgtgaaaatgtcctcatgtcaaccaacttgacggcaactagtaccatatatattttaaaacaagaaaatactcaaagtacctatcgggtgaatccagatggttccctgcgtgtcacttttgccagcgggatggagatcggcctcagctcagagccccacatcctggcaggggcagtcaaccctaccctgggcaaatgcaacatctcattgcccggagagcacaatgcaaacctcatcgagtggcggcagaggaaggagcaaaacaaaggcaatgtttcggcttttgaaaggaggctgagggcccacaacagaaacctactctccatagattttgatcatataacccgcacaggaaagatctatgatgaccatcgaaaattcacccttcgaattctttatgaccagactgggcgacccattctgtggtctcctgtaagcagatataatgaagtgaacatcacatattcaccttcgggattggtgacgtttattcaaagaggaacgtggaatgaaaaaatggaatatgaccagagtgggaaaattatttcaagaacttgggctgatgggaaaatttggagctatacctacttagaaaaatctgtgatgcttctcctacacagccagcggcgttacatctttgagtatgaccaaccagattgtctgctctcagtcaccatgcctagcatggtgcgtcacagcttacaaaccatgctttcagtgggctactaccggaacatctacaccccaccggacagtagcacttcttttatccaagactatagtcgagatggccgattgctacagaccctgcatctggggacagggcgcagagtcttatacaagtacaccaagcaagcaaggctttctgaggttctctatgataccactcaggtcacattaacatatgaagagtcttctggagtgattaagacaatacacctgatgcatgacggattcatctgcacaatcagatacaggcaaacaggacctcttattggacgccagattttcagattcagtgaagaaggccttgtgaatgcacggttcgactacagctacaacaatttccgagtcacaagcatgcaagctgtaatcaatgaaacccctttgcctatagatctttaccgatatgttgatgtctctggcagaacagagcagtttggaaaattcagtgtaattaattacgatttaaatcaggtcataactactacagtgatgaaacacaccaaaatcttcagtgccaatggacaagtcattgaagtccaatatgaaatcctaaaggcaattgcctactggatgaccattcaatatgataatgtgggccgcatggtaatatgtgacataagggtaggagtagatgccaatataacaaggtacttctatgaatacgatgctgatgggcaacttcagactgtttctgtaaatgacaaaacccagtggcgttatagttacgatctgaatggaaacatcaacctcttaagccatgggaagagtgctcgtcttactcctctccgatatgacctccgagaccgcatcaccagattaggagaaattcagtataaaatggatgaagatggctttctgaggcagaggggaaatgatatttttgaatataattctaatggcctgctgcagaaagcctacaataaggcttctggctggactgtgcagtattactatgatgggcttgggcgacgtgtcgcgagtaagtccagcctagggcagcaccttcagttcttttatgcagaccttaccaaccccataagagttactcatttgtacaaccacacaagctcggagattacatctctgtattatgatctccaaggtcaccttattgccatggagttaagcagtggtgaagaatattatgtagcctgtgataatacaggtaccccactagctgtgttcagcagccgaggtcaggtcataaaggagatactatacacaccttatggcgatatctatcatgacacttaccctgactttcaggtcattattggttttcatggaggactctatgatttccttactaaattagtgcacctggggcaaagggattatgatgttgttgctggcagatggacaacgcctaatcatcacatatggaaacagttgaacctccttcctaaaccattcaacctctactcctttgaaaataactacccagttggcaaaattcaagatgttgcaaagtataccacagacatcagaagttggttggagctatttggtttccaattacacaatgtactacctggatttcccaaacctgaattagaaaatttagaattaacttacgagcttctacggcttcagacaaaaactcaagagtgggatcctggaaagactatcctgggcattcagtgtgaactccagaaacagctcaggaatttcatttccttggaccaactacctatgactccccgatacaatgatggacggtgccttgaaggagggaagcaaccaaggtttgctgctgtcccttctgtttttgggaaaggtataaaatttgccatcaaggatggcatagtaacagctgatattataggagtagccaatgaagatagcaggcggcttgctgccattctcaataatgcccattacctggaaaacctacattttaccatagaggggagggacactcactacttcattaagcttgggtctctggaggaagacctggtgctcatcggtaacactggggggaggcggattctggagaatggtgtcaatgtcactgtgtcccagatgacttctgtgttgaatgggaggactagacggtttgcagatattcagctccagcatggagccctgtgcttcaacatccggtatgggacaactgtcgaagaggaaaagaatcacgtgttggagattgccagacagcgcgcagtggcccaggcctggactaaggaacaaagaaggctgcaagagggggaagaggggattagggcatggacagaaggggaaaagcagcagcttttgagcactgggcgggtacaaggttacgatgggtattttgttttgtctgttgagcagtatttagaactttctgacagtgccaataatattcactttatgagacagagcgaaataggcaggaggtaacaaaaatatctctgcctttgcgtcaccaaagactgcctgtttttaaaacataaaatggtttattgtattggttttctagatcagaactctgtatatgtaaatatggaggaaaaacatatccaactgcctttcaatgtgacggaagatggtattttaatattgtttgtttaaactctttaagaaatgacagagatttttagttcttgtgtggcagtattcaaaataacacaagtagaactcaaacagctaaaaacagttttcagaaagcaccactttcaatttgccgagccatgcatatgttccaatatccagaaagaacccaaggttctctatctctattgtgagaagcagtttcatccttaactgttggcagaacttacgggctatttgaataggtggtgcaatagtatctgaaacttgcctttcgaaagactgccagccctttgacgttttccagatctgttataggaaacttaaaaacaggtgtaaaatgtcttcagccaccatctcctagagtgaggacccaattgcccttccttcttgattattcctccttgcttgttaaagtaaatgccatattgttgtgctgtgttttggcgtgtggtggctgggttctgtctaccatgcttccctgtgggtgtggtaaccagactgtatagccgctatttgctcgtgtgtacatgataccaaagcagctggccagcgtgacctctctcacacgacctgttttgactcaattttttactaaaagttgttcagctgtattggtatcatgtaaacatagcttttattaacctgggtaggaatttctcatttatatataggatgtgttttggtcatagtttcacattagtgattcagtatctatacactgacccaatggttttgtgcacatgaacggtaatttacttaaaagtatgattctggtacaaaaacaaacaaaggctttagcaggcatacgtgtctgggatgccgatacatacattaactactactgcagaaattcataagagccaaaaccttaaaaaaatagacctggtacttaagtgaaagtactaaagggaagaccagaccaaacatcacagcagttgctgccacattgtttcagcccacttagatttatctttcaaatgtacaattctgtattgaacatctcccagccatcttcaggaaatcgaatcaagtaaatcctttccaaccgaaaacatttcaactaactatagagaggcagactcatttttactaaaataatttatacagttagttattttcgttctccgtacttacccatttatctttatttaatcgtctctactgcctaggaaaataactattttccaggacgggttatttgttctgcgatcatttaaaatttggagaaaggtcaggattagtgttaatatcagctgcagtttctcaatctctaggaatcctgcagtaaaacaagccccttggtgagctggaagatttgtgcccagtgacaaagagatagtttgtaaaatgctgtgtaattgtaagttaccacaaatgaaaatacatgacagcacaatgtggcccgtagaaaattcccctgagccagcttctgcactttcatcaccgaatctgaacatttgctatgtctgaaggcaaatttatgatggaatgttagtttggattctttccagatgctacctaaatgcagtgtggggtcattgccttgctttgcgatgacagtttctttgaaaatatgcaaagtcataagctcatgttaaggtttttcaagagtctgcctcctactacacaaaggaaagcaagggaaaggaaatgaccctggcaaacagtagggaagggtgtattcaaacatttcattttcaaaaccttcgggttagaataccacttacacatgtattctgagagacagaattcatgaggaactcatctctctttataactggaaacacaccagcttgatatattgctaatccatactaaaatcatattattgggttttttctgaatcaggcctgtattaatggtacagtatttattcagaatggaattctaaaattactaacaaacttgttgaaaatttgaatacctccacaccaacctaaaaatggaccttaagttcctagaacctctgatgttcttttaaattaatggaaaaataatttgtgaactgtatatagagagtgcattcataaatgtgattatgtattttatcacaaatccaaaatgtcaatattagagtctattttgcttatattttaagcaattatacgtttttgcaattcattgatgatgtatcattttcaaactgctttaaatatccattagaaacaaatatttgaagcttttacttaatagtgattaccttgaactgtgcatttctagtttgtaatacgtatttggttggttcgtgcctttagtttgttaaagttacatttgtattatattcaggaaatgcactttttattacttacagctgtggttttaatactgccttgaactattattattctttttacaactcctaaagcttgagggaggaaagaaaaaaaaaacaaaactactaatcagtagtaaatcgaagagaaacattttggcatttcttaagaagaagatggagatattgagtatatcacttcctattcagctgaatagaaagaatgccttcattgacttgcagttctgcagtttaaattattgaaagaacaattcgtttgcatttcctgatgaaagtaaaagcatttttcagagaaacatatgaatttctcatacccagcagacagatggctgacactgcacagccacacaccattcgagtaagttaaagtgagagcatagtagttggactctcctatgaagaacattctgggctggaggcagggaatactccatggttgtttctttttcctacttaagcccattttgtttgtgcttttctgttttgttttgttttcactcttgcactacagtctagagatccaaatgaactgaaaagttcaaagtttaacacatttaaatatgtttacttttagttgtcattctaatcgttattgattagaagcatgactcctgaaggaaagggaaataaatctcaattcatactaacttgcaacaaaacacttttaccatataaataagtatatgatttatttttaacccaaaaaatgtataaaataagtgtgtcctttactgtcaatttatctagaagatctataatatatagactacatatatataatatatacaacatagccaaatgtatgaaaacttgacaatgtataatttggaattcacatgctacctatgtagacaggtatgaaattaagttataattttcatgagacattttcatcactgttgacacagtttcaagcattccatcatgttattttgactctttttcttttttttttctttaaaaatatatttttaactagaccaggccccactataatatcacttaagagagtcagggcaaagtttttgcatttatgaagatgtgttcatgtaagggtgattgtaatggagttcattggtaatagaagcaaaagtacagtaacgaagtattgaaaagaaaattttggagacattggagcatattatatatagcttgtggaaagacataaggctacagatggaatggaacattcctgttttcttgaagaaattcacatacacatagctgacctgactagtacttcagctcttccacagccttctataaaggttctttcttctgcaaagaaaacaaaacaaaacaaaacaaaacaaaaaaaacaaaaaaagcgcaaaaaacaaaaaaacaaaaaaaagcaaagtaaaatttaaaaatacagaaaacaaacaacaaaaaagaattcaaccataaatagtgactattattttcagtgtgtccttcatgtgaaagctattaaggaccaaatatactactgttcataagaagaaattactttctaaacagtaactgaaaatacttagagttaaacttgctgtggattttgtcttggcagttgtcatcttacattatttgtcaaaggaaatgtgtttggcagttaaaaatctttccttagatttagtggtggactttaacctcttaaataaatgttagtatatcagattgtgtccttgaaaaatattttacttgtatgaatcatgacaacgtctaaatctttactattcttctggcaaaagcatcagtaagaaagaaggcgaaaaagagaagtatagcctttatgtcagaaaaacattctttttagctgcttactttctcatgaaaagtaaagatgtttacagtgtatgccaagttttcagtttctgtataacaacaggtagaggttctaatcatattgaaaattgtgttataatggtctgagccatgttgctaggaaacaataggttccaattttgtattcctgctctcctgtgctgaaaagtgactggatactgtacaggttcatgttctctggctgcagttaaatggtcttttgcattttgctctggctttcaggccagaagcatgcatttttctacaagagcatcacaacaacatgctgtaaatatttaaagttaaacattatgtgttgatatttgaaagaaaagtactttgaatatttcatttttaaaaaataaaattgccaatgaaaaa

SEQ ID NO: 748 - DNA, 384 bp, Homo sapiens
tgaaaaaggaggtctgttgccccctttttttaagaaactctctaccatgaagattcaactttttttctttattctgcacttttgggtcacaattttaccagccaaaaagaaatatcctgagtatggtagcttggacttgaggagagagtgcagaataggtaatggtcaatgtaaaaatcagtgtcatgaaaatgaaattaggattgcttactgcataagacctggaactcattgctgcttgcagcagtaacgatgacagaagaaaagagtcacaagctccaagaagagagaccagcgttattaagttttcccagcacatccttcaaggcgtgtgtgtctctataatacacaagaactaaataaaaattaatgttgaaccattca

SEQ ID NO: 749 - DNA, 872 bp, Homo sapiens
accttccttctgtcaatagatgaaacaaatacttcatcctgctctggaaaccactgcatgtaccaatcattttaatgcagatccctgttccaccggttttgttttcccagcaatgacattattcccagtgctgttgttcctggttgctgggctgcttccatcttttccagcaaatgaagataaggatcccgcttttactgctttgttaaccacccaaacacaagtgcaaagggagattgtgaataagcacaatgaactgaggagagcagtatctccccctgccagaaacatgctgaagatggaatggaacaaagaggctgcagcaaatgcccaaaagtgggcaaaccagtgcaattacagacacagtaacccaaaggatcgaatgacaagtctaaaatgtggtgagaatctctacatgtcaagtgcctccagctcatggtcacaagcaatccaaagctggtttgatgagtacaatgattttgactttggtgtagggccaaagactcccaacgcagtggttggacattatacacaggttgtttggtactcttcatacctcgttggatgtggaaatgcctactgtcccaatcaaaaagttctaaaatactactatgtttgccaatattgtcctgctggtaattgggctaatagactatatgtcccttatgaacaaggagcaccttgtgccagttgcccagataactgtgacgatggactatgcaccaatggttgcaagtacgaagatctctatagtaactgtaaaagtttgaagctcacattaacctgtaaacatcagttggtcagggacagttgcaaggcctcctgcaattgttcaaacagcatttattaaatacgcattacacaccgagtag

SEQ ID NO: 750 - DNA, 2723 bp, Homo sapiens
ttcctgttggacacaaagtccccggggcatttctgcagcgccagctccttgtgcggggcctggcacatacgatgttcaagcaaggcttgggatcaataaaggagcgggcattccatattctcggccggaagttacactggctcccagacctattattgcattaagagttgcacaatacgattttccaattctgttattcctgctgcattcttgcgtgaaaaagacttttccctcaactgtctgcagcaacctccttccctcctctgagctaaatccgcatgtctgaaggaagttgtcctgcgtgtcccactaaatacaggctcctttcagctccctcggagtggggatgggaagaacctgtagcgagcacctactctgtgctttagcaagtgagatctcctttcatttgcacaacagcccctgggtcggagctgaacagccccactggatggatgagaagacccagaccaggggagttaaatgacttgtccaaggtgacctggcaagttacaggctgaactgggattgatcccagatctacccggccctaaaagttatgccctttctcctccactcactttccttccaggcctgagttccttcccttcctgatagtgtggtcggtgcagatctcagaacgtgtaaacctggtgacaccagatccgtcactttacagtgagtaaaggaagtacccagggatcggcttactaattctaggggccggtgaattattcatgccaccattaacttggaggccctttcagcctcacctctctttcccttgctccggaccctgagatcctggcctacctgagctcggcagacctgtgggggcccctggtgaggagatgctggcagagtggggggcttgcctgctgctggcagtggcactgctgggcccagggctccaggcccaagccatggaaggtgtcaaatgtgggggtgtgctctcagcaccttctggaaacttctccagccccaacttccctagactgtacccctacaacacagagtgcagctggctgatcgtggtggccgagggatcctcggtgctgctcaccttccatgcctttgacctagagtaccacgacacctgcagcttcgactttctggagatctacaatggggcctcaccagacaagggcaacctgctggggaggttctgcggcaaggtgcccccgccgcccttcacctcctcctggcatgtcatgtctgtcatcttccactcggacaagcatgtggccagccatggcttttctgcgggctaccagaaagatgtgtgtggcggcgtcctgactggcctgtcaggggtcctcaccagtcctgagtatcccaacaactacccgaacagcatggagtgccactgggtgatccgggccgctggccctgcccacgtcaagctggtgttcgtggacttccaggtggagggcaatgaagagtgcacctatgactacgtggctgtgcttggggggcctggccccacccgtgggcaccactactgtggcagcaccaggccccccaccctcgtgtctctgggccacgaactgcaggtggtcttcaagtccgacttcaacatcggaggccgtggcttcaaggcctactacttctcaggagaatgccaggaggtatacatggccatgcggggcaacttctccagcccacagtaccccagctcctaccccaacaacatccgctgccactggaccatccgcctgcccccgggctaccaggtcaaggtgttcttcctggacctggacctggaggagcccaacagcctgaccaagacctgtgactttgaccatctggcggccttcgatggggccagcgaggaggcacccctgctggggaattggtgtggacaccacctgccaccacccgtgacctcaagccacaaccagcttctgcttctgctgcacacagaccgcagcaccacccgcaggggcttctctgtggcctacatcggaggtcagctgggctgtgggagtgggtccactgagggcgaaggggaggctttgcagcctcagtctttgcagtctccttcctccatcccaccagtttgtcctgccccccccatgaatggtcttctccagctccttctccattggctacacccttgcccactctcgggacccctaagactggacggtacggctcccgcttgtttccactattgcagagcctccttccccagcttctaacttcgtgagtcctcacccctccccatctggttccttccccctgggcccctggcccctcttgtgttgttattggtcccctgtatccaggggaaatagacaaaatatggtaatattgtttatggcaaaaaaattggtataactgtggggatgtctaccagccctgcttgtatcattcagaactactcattgaaaacatggtgcttgtttttcctcactcaacaggaagcctggagctaggcagctgctgtattggtccaggggctcaacactgttccaaatgttatctctgggactctctgagcctcacagctgcaagatggctgccatagctccaggcatcgcatccatgttcaagactggaggggacaggggaagtgccagctgcaaatggctctttatcaagaaagcaaaagcatctctagaacctctcataagacttttacaaaatgtcccatcagtttgaactcagtcagatggccatgcctggctgcagaggaagctggggagctggtatttggctttctc

SEQ ID NO: 751 - DNA, 2606 bp, Homo sapiens
aggtgctccgctccagagttgagcgcaggtgagctcctgcgcgttccgggggcgttcctccagtcaccctcccgccgttacccgcggcgcgcccgagggagtctcctccagaccctccctcccgttgctccaaactaatacggactgaacggatcgctgcgagggtgggagagaaaattagggggagaaaggacagagagagcaactaccatccatagccagatagattatcttacactgaactgatcaagtactttgaaaatgacttcgaaatttctcttggtgtccttcatacttgctgcactgagtctttcaaccaccttttctctccaaccagaccagcaaaaggttctactagtttcttttgatggattccgttgggattacttatataaagttccaacgccccattttcattatattatgaaatatggtgttcacgtgaagcaagttactaatgtttttattacaaaaacctaccctaaccattatactttggtaactggcctctttgcagagaatcatgggattgttgcaaatgatatgtttgatcctattcggaacaaatctttctccttggatcacatgaatatttatgattccaagttttgggaagaagcgacaccaatatggatcacaaaccagagggcaggacatactagtggtgcagccatgtggcccggaacagatgtaaaaatacataagcgctttcctactcattacatgccttacaatgagtcagtttcatttgaagatagagttgccaaaattattgaatggtttacgtcaaaagagcccataaatcttggtcttctctattgggaagaccctgatgacatgggccaccatttgggacctgacagtccgctcatggggcctgtcatttcagatattgacaagaagttaggatatctcatacaaatgctgaaaaaggcaaagttgtggaacactctgaacctaatcatcacaagtgatcatggaatgacgcagtgctctgaggaaaggttaatagaacttgaccagtacctggataaagaccactataccctgattgatcaatctccagtagcagccatcttgccaaaagaaggtaaatttgatgaagtctatgaagcactaactcacgctcatcctaatcttactgtttacaaaaaagaagacgttccagaaaggtggcattacaaatacaacagtcgaattcaaccaatcatagcagtggctgatgaagggtggcacattttacagaataagtcagatgactttctgttaggcaaccacggttacgataatgcgttagcagatatgcatccaatatttttagcccatggtcctgccttcagaaagaatttctcaaaagaagccatgaactccacagatttgtacccactactatgccacctcctcaatatcaccgccatgccacacaatggatcattctggaatgtccaggatctgctcaattcagcaatgccaagggtggtcccttatacacagagtactatactcctccctggtagtgttaaaccagcagaatatgaccaagaggggtcatacccttatttcataggggtctctcttggcagcattatagtgattgtattttttgtaattttcattaagcatttaattcacagtcaaatacctgccttacaagatatgcatgctgaaatagctcaaccattattacaagcctaatgttactttgaagtggatttgcatattgaagtggagattccataattatgtcagtgtttaaaggtttcaaattctgggaaaccagttccaaacatttgcagaaaccattaagcagttacatatttaggtatacacacacacacacacacacatacacacacacggaccaaaatacttacacctgcaaaggaataaagatgtgagagtatgtctccattgttcactgtagcatagggatagataagatcctgctttatttggacttggcgcagataatgtatatatttagcaactttgcactatgtaaagtaccttatgtattgcactttaaatttctctcctgatgggtactttaatttgaaatgcactttatgcacagttatgtcttataacttgattgaaaatgacaactttttgcacccatgtcacagaatacttgttacgcattgttcaaactgaaggaaatttctaataatcccgaataatgaacgtagaaatctatctccataaattgagagaagaagaaggtgataagtgttgaaaattaaatgtgataacctttgaaccttgaattttggagatgtattcccaacagcagaatgcaactgtgggcatttcttgtcttatttctttccagagaacgtggttttcatttatttttccctcaaaagagagtcaaatactgacagattcgttctaaatatattgtttctgtcataaaattattgtgatttcctgatgagtcatattactgtgattttcataataatgaagacaccatgaatatactttttttctatatagttcagcaatggcctgaatagaagcaaccaggcaccatctcagcaatgttttctcttgtttgtaattatttgctcctttgaaaattaaatcactattaattacattaa

SEQ ID NO: 752 - DNA, 1590 bp, Homo sapiens
gcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttcccggacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggccatg

SEQ ID NO: 753 - DNA, 4127 bp, Homo sapiens
aagacaacgtcactagcagtttctggagctacttgccaaggctgagtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccggcaaggaccccgtaggacgtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaaggcggccgcggccgaggcccgccacgaggtgcgccagctgcacagcgccttcgccgccctgctggaggacgcgctgcggcacgaggcggtgctggccgcgctcttcggggaggaggtgctggaggagatgtctgagcagacgccgggaccgctgcccctgagctacgagcagatccgcgtggccctgcaggacgccgctagcgggctgcaggagcaggcgctcggctgggacgagctggccgcccgagtgacggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggccgaggccggggccggggccgcctccctcaacgcctcccttcacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacggcctgggctccaactcttcaccacaccctgtattctacaacttctttggtgttttgctcctcctgtggttggaaacttctgtacaacactttaaacttttctcttgcttcctcttctcttctcccttatcgtatgatagaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggcagctgagggaggagggaaagaagactgtaaaaatccccctcactaatgatcaactttggaataaagtgatgcccttcaaa

SEQ ID NO: 754 - DNA, 888 bp, Homo sapiens
ctctgcccattgggaaacacctctctatgactctataaatgtccaaggtggccccaagggaggacttctgcagcacagctcccttcccaggacgtgaaaatctgccttctcaccatgaggcttctagtcctttccagcctgctctgtatcctgcttctctgcttctccatcttctccacagaagggaagaggcgtcctgccaaggcctggtcaggcaggagaaccaggctctgctgccaccgagtccctagccccaactcaacaaacctgaaaggacatcatgtgaggctctgtaaaccatgcaagcttgagccagagccccgcctttgggtggtgcctggggcactcccacaggtgtagcactcccaaagcaagactccagacagcggagaacctcatgcctggcacctgaggtacccagcagcctcctgtctcccctttcagccttcacagcagtgagctgcaatgttggagggcttcatctcgggctgcaaggaccctgggaaagttccagaactccacgtccttgtctcaattgtgccatcaactttcagagctatcatgagccaacctcaccccacagggcctcagtcgccaccatgtgggcctctccagtgcaaaccaccgagcattccaccatgaccggtcacagctacaaatccagagaccatcaatcctgctagagtgcagggtggcaagcacccaagggtggctgaccaagactgcagagtctcctccatcttcaggtccattcagcctcctggcatttaactaccagcatccagtggtccccaaggaatcccttcctagcctcctgacatgagtctgctggaaagagcatccaaacaaacaagtaataaataaataaataaactcaatgcagacaca

SEQ ID NO: 755 - DNA, 2058 bp, Homo sapiens
agtatcctctgatcacagaagagaaagctgcccctacccagggacatgatcctgagccacctggattgtgagggagaatcaggcattgatgaggaggggaatgaggaagtagtctgcctacaggggacatagctcggcacagctccacagagctaggggctgcaacttggggcatgagaagagagagcagcaagagaaccatttgagaaggctgtcctttctctgtcatcactcctgatgccctggtgagctccacggtgcaggaacctccatgtgtgtgctgcatccccaagttctggtggcagcaggtgcttagcagcccttgtccagtctcgcctgtgacactgctgctcccttcccctgtcctgacctcctggttggctgtcctgccagagccttgcctggaagatgaaattccagctaccctgtgggagcagtaacgccttcttccttcttctcaatctccagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatca

SEQ ID NO: 756 - DNA, 1723 bp, Homo sapiens
tggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatca

SEQ ID NO: 757 - DNA, 1741 bp, Homo sapiens
atggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatca

SEQ ID NO: 758 - DNA, 829 bp, Homo sapiens
tgcccagactggtcttgaactcctgggctcaagcgatcctcccaaagccctgagattacaggcgtgagccagcgcgccggacacaacctcctactttcatgaaagagtgggcacttccaacaggaggaaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaa

SEQ ID NO: 759 - DNA, 1600 bp, Homo sapiens
ttgctttctgagagatgcaggtggattcttgggcatttgctattaacttccttccaaaatgtcaccattcctgtatctggttctcttggtacttgggcttcatgctacaatccactgtgcatcacctgaaggcaaagtaacagcctgccattcatcccaaccaaatgccactctctacaagatgtcatccattaatgctgactttgcattcaatctgtaccggaggttcactgtggagaccccagataagaacatcttcttttcccctgtgagcatttctgcagctttggttatgctttcctttggggcctgctgcagcacccaaactgagattgtggagaccttggggttcaacctcacagacactccaatggtagagatccagcatggcttccagcatctgatctgttcactgaattttccaaagaaggaactggaattgcagataggaaatgccctcttcattggcaagcatctgaaaccactggcaaagttcttgaatgatgtcaagaccctctatgagactgaagtcttttctaccgacttctccaacatttctgcagccaagcaggagattaacagtcatgtggagatgcaaaccaaagggaaagttgtgggtctaattcaagacctcaagccaaacaccatcatggtcttagtgaactatattcactttaaagcccagtgggcaaatccttttgatccatccaagacagaagacagttccagcttcttaatagacaagaccaccactgttcaagtgcccatgatgcaccagatggaacaatactatcacctagtggatatggaattgaactgcacagttctgcaaatggactacagcaagaatgctctggcactctttgttcttcccaaggagggacagatggagtcagtggaagctgccatgtcatctaaaacactgaagaagtggaaccgcttactacagaagggatgggttgacttgtttgttccaaagttttccatttctgccacatatgaccttggagccacacttttgaagatgggcattcagcatgcctattctgaaaatgctgatttttctggactcacagaggacaatggtctgaaactttccaatgctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaggccattggctaattgcacgtgtgtattgcaatgggaaataaataaataatatagcctggtgtgattgatgtgagcttggacttgcattcccttatgatgggatgaagattgaaccctggctgaactttgttggctgtggaagaggccaatcctatggcagagcattcagaatgtcaatgagtaattcattattatccaaagcataggaaggctctatgtttgtatatttctctttgtcagaatacccctcaactcatttgctctaataaatttgactgggttg

SEQ ID NO: 760 - DNA, 706 bp, Homo sapiens
aaagcagaaataaatgatatctttcattctatcggcaagaacacaagactggttatgtgaaaggaggaggcgtcattcctgcggaagccctatcccacatgacgaacgacaaggccaggggcaagcaaaaagaggaaggactctcttgctctgctccgacttggccagtagaggcagtgaggagctaaagatcattccttctttccttccttcactctccgtagacagctctgcagggaagtctgtgacaacctggccagacatagggctcacgatctgatcagagtcatggcaccccagactctgctgcctgtcctggttctctgtgtgctgctgctgcaggcccagggaggataccgtgacaagaagaggatgcagaaaacacagctatccccagaaatcaaagtctgccagcagcagcctaaactatatctatgcaaacacttatgtgaatctcaccgagattgtcaagcaaataacatatgctgttctacctactgtgggaatgtttgcatgagcatcctgtgagtgggagagtgggctgggatgtgcatcctgcttcccaactcctctatccaagactgtgcccacatccgaagcacaaggacctcaagtcaccagcataagaacatcaacaggaatgccgccctctctactgtctgaaccccttgtccctgtcaaataaaccagaacaaatgcccaggga

SEQ ID NO: 761 - DNA, 486 bp, Homo sapiens
atgggactctcaggacttctgccaatcctggtaccattcatccttttgggggacatccaggaacctgggcacgctgaaggcatccttggcaagccgtgtcccaaaatcaaagtggaatgcgaagtggaagaaatagaccagtgtaccaaacccagagattgcccagaaaacatgaagtgttgcccgttcagccgtggaaagaaatgtttagacttcagaaagatatatgcagtatgccacaggaggctggcccctgcctggcctccataccacactggtggtacaataaaaaaaactaagatctgctccgaattcatctatggcggtagccaggggaacaataacaacttccaaactgaagctatctgtctggtcacctgcaaaaaataccataagtcagccttactttataccataaggaggagcttgaataacctccaggatttggctcataatccaggcctctctccacgtgtgcctgattga

SEQ ID NO: 762 - DNA, 620 bp, Homo sapiens
acaccggggcaggcaaagtgcagatgtaggagctgctgaggagcagttcttagttttggtgccatcaaccaggccagtacttcctaaaatgggactctcaggacttctgccaatcctggtaccattcatccttttgggggacatccaggaacctgggcacgctgaaggcatccttggcaagccgtgtcccaaaatcaaagtggaatgcgaagtggaagaaatagaccagtgtaccaaacccagagattgcccagaaaacatgaagtgttgcccgttcagccgtggaaagaaatgtttagacttcagaaaggtcagccttactttataccataaggaggagcttgaataacctccaggatttggctcataatccaggcctctctccacgtgtgcctgattgatgctccaaattggcttccacgggccaaaccttggctgttccagaaactgaaccccaggaattgcttacacactttcttccagcgtagcatctcttcaaacacaatgctcttccccttgaccacttctcagtatgaaactctatgtcttcaactttcagaccccccatttatttgtatgaaggcttcagttgccttaataaagtgctctgtggggtccga

SEQ ID NO: 763 - DNA, 614 bp, Homo sapiens
ccccctcccgcgcgcgcggttaaatccccgcacctgagcatcggctcacacctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatgataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 764 - DNA, 1496 bp, Homo sapiens
gccggaagcggagagcggctgatcgcagtccggaggtgaggcggaactctgagcaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagc

SEQ ID NO: 765 - DNA, 1746 bp, Homo sapiens
gctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaagg

SEQ ID NO: 766 - DNA, 3105 bp, Homo sapiens
gcggagcgtggcctcgatcaccaccgagagctgacggccgcccggattcccgccctcagagaatcctggcccccagtcgttccaagaccctttacggactgcagcttaaaggaaccggcctctgccattgagaccaaactgacagaggaactggtcactcttctgttctttccagagaggagcttagccagggacttctgcccttcctgggcccgggcctcgggggcgattccgggtaggtaaagcggaacgagggcgtggcctctcttgtgagcccgccctccccgtgtcgctcccgccttgagggcggggctctttcccaagtgccctctgtgagagccgggccgctctctccggggcgtggcgaagaggggcggagtcacgagcggggcggtgagacttcctgcccagtcgcgggccagcctagcgcttcagccggcggctcatttccggtgggggcgccgcgcccagtgagggcccggaagtgggtcgcgcggagattgctgggcggttcttgccggaagcggagagcggctgatcgcagtccggaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttgc

SEQ ID NO: 767 - DNA, 1563 bp, Homo sapiens
ggaagcggagagcggctgatcgcagtccggaggtgaggcggaactctgagcaggtggtccattatggctgacatgcaaaatctggtagaaagattggagagggcagtgggccgcctggaggcagtatctcatacctctgacatgcaccgtgggtatgcagacagtccttcaaaaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctaga

SEQ ID NO: 768 - DNA, 2964 bp, Homo sapiens
gtggcctcgatcaccaccgagagctgacggccgcccggattcccgccctcagagaatcctggcccccagtcgttccaagaccctttacggactgcagcttaaaggaaccggcctctgccattgagaccaaactgacagaggaactggtcactcttctgttctttccagagaggagcttagccagggacttctgcccttcctgggcccgggcctcgggggcgattccgggtaggtaaagcggaacgagggcgtggcctctcttgtgagcccgccctccccgtgtcgctcccgccttgagggcggggctctttcccaagtgccctctgtgagagccgggccgctctctccggggcgtggcgaagaggggcggagtcacgagcggggcggtgagacttcctgcccagtcgcgggccagcctagcgcttcagccggcggctcatttccggtgggggcgccgcgcccagtgagggcccggaagtgggtcgcgcggagattgctgggcggttcttgccggaagcggagagcggctgatcgcagtccggagcaggtggtccattatggctgacatgcaaaatctggtagaaagattggagagggcagtgggccgcctggaggcagtatctcatacctctgacatgcaccgtgggtatgcagacagtccttcaaaaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttacc

SEQ ID NO: 769 - DNA, 2217 bp, Homo sapiens
gagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaa

SEQ ID NO: 770 - DNA, 4822 bp, Homo sapiens
actcgcgggaaccgcaccaagcgggtggctgcaggagctcgcccatcgcccctgcgctgctcggaccgcggccacagccggactggcgggtacggcggcgacagacggattggccgagagtcccagtccgcagagtagccccggcctcgaggcggtggcgtccgcgtcctctcgtccaggagccaggacaggtgtcgcgcggcgggcgctccagggaccgcgctgaggccgcggtcgccgcccgtcccgccccgccccgccgcccgccgcccgccgagcccagcctccttgccgtcggggcgtccccaggccctgggtcggccgcggagccgatgcgcgcccgctgagcgccccagctgagcgcccccggcctgccatgaccgcgctccccggcccgctctggctcctgggcctggcgctatgcgcgctgggcgggggcggccccggcctgcgacccccgcccggctgtccccagcgacgtctgggcgcgcgcgagcgccgggacgtgcagcgcgagatcctggcggtgctcgggctgcctgggcggccccggccccgcgcgccacccgccgcctcccggctgcccgcgtccgcgccgctcttcatgctggacctgtaccacgccatggccggcgacgacgacgaggacggcgcgcccgcggagcggcgcctgggccgcgccgacctggtcatgagcttcgttaacatggtggagcgagaccgtgccctgggccaccaggagccccattggaaggagttccgctttgacctgacccagatcccggctggggaggcggtcacagctgcggagttccggatttacaaggtgcccagcatccacctgctcaacaggaccctccacgtcagcatgttccaggtggtccaggagcagtccaacagggagtctgacttgttctttttggatcttcagacgctccgagctggagacgagggctggctggtgctggatgtcacagcagccagtgactgctggttgctgaagcgtcacaaggacctgggactccgcctctatgtggagactgaggacgggcacagcgtggatcctggcctggccggcctgctgggtcaacgggccccacgctcccaacagcctttcgtggtcactttcttcagggccagtccgagtcccatccgcacccctcgggcagtgaggccactgaggaggaggcagccgaagaaaagcaacgagctgccgcaggccaaccgactcccagggatctttgatgacgtccacggctcccacggccggcaggtctgccgtcggcacgagctctacgtcagcttccaggacctcggctggctggactgggtcatcgctccccaaggctactcggcctattactgtgagggggagtgctccttcccactggactcctgcatgaatgccaccaaccacgccatcctgcagtccctggtgcacctgatgatgccagacgcagtccccaaggcgtgctgtgcacccaccaagctgagcgccacctctgtgctctactatgacagcagcaacaatgtcatcctgcgcaagcaccgcaacatggtggtcaaggcctgcggctgccactgagtccacccgcccggcccagctgcagccacccttctcatctggatcgggcccctcagaagcaggaaaccctcaaacccagccagaccccaggccggggcattgccagggaggaccctcacaaccacgtacatgaccctttctccttcatgccaggctcctatgctccccttgccctgccaggcatttgtgtgactgtcctgtttccagcccaggtggtctcaatcatcaggcagtgttctacccaaatgcaaacgcctctcccggaggcatgtcctggctggttctttggggttggcacagaagtcctgtctgaggtcctatccatgccccttactggctcaggtcgtgagatagatgtggaatgacctgagaggcacctggagcccactgttggccaccttgagctcttcaccatccatcacagggtgtggtgtgtgtagtcagggtctggttggctccccattgcctgcccgaggtgcaaggtggggtataaaactggataacccctgaagtattgtatattcatggatctgaagcactgatccactggtcacaggtagacatgtggagtcaactcaagaaaaagctgagtgaacagcatgatttagggctaaagccaatggcatttatcttcccttgtcttcctgctttgcatttgcctctgccatctaggaaagacatgtaagagcatggacattttactttggagaaacagaaaaatcttggggcttccaattgacccatctatctgccaccatgttgccccaccaggagctcagctctgtggagttttccctttgctgagcaagcatgtggttgcattgggtggcccaggatgacaatgcacagcacagatgccatcatttccctttcccctctgaatggcagacatcagtaatcaatctggaatgtttttcttccaaatctgagtggaattttcaaatgatcagcacagccactgccaacagatatgatgtaaagtgaaacctggttgccatcttctgccatgctgaggagcagtccatccctgcccgagcatgtatcggcaacatgggcagcctgtgaccgggtctggggcgaggccaggggccatcaaaaacaggctgatcaccaaagtcagtgtcaccctggatgcccagcagccctgtcctgtgtcttgggcctgtgagtcaaagaaaaggtccttttcagggagtgacaagtagtaattaggctgagttgggtggagaggtttgtctcagcctctgctgttctcggaaactgctgttctccttggagcagccactgggagttggagtgtttatttgatttctgacttgctaagcctgtaatttacctgctggaatagacagagtccagctgcccaaaccgtgtcattaaaagcagatcctgcgcccgccccatccacaggcacagcccggcagagtggttccacctccccatgggcccaaggatgcgcctctctggagttcacgtgctgcacccccagggaggggcctggggaaagctggtccagcagcaggggtggaggctggggccacactgcgggacagcagcccctccacctggaccagggagggcctccatgtgcaagcgcagaggaagagaccctcccatgtacgcaaagggcagccccaggctgtctggaagttggagaattccctatcagcacagggatctcagctctggcctggaggtgaagagacctgccttgtaggtggcttccttatctgcgcctccattttctatctgcactttttgatctccaaacaaccttcagccaaagaatctgtctaccaactcctcatagtgagccagaagcagcctcataaccctgaatgtggggctctggtggctgtcacgaagcagagttggcacataacatggaacctggccaggcatggtggctcacacctataaccccagcactttgggaggccaaggcaggcagatcacctgaagtcaggagttcaagaccatcctggccaacacagtgaaaccccatctgtactaaaaatacaagattacctgggcatggtggtgcatgcctataatcccagctactcaggaggctgaggcagaattgcttgaacctgggaggtggaggttgcagtgagcagagatcacaacattgcacttcagcctggtgacatgagcaaaactgttgtctcaacaaaatgaaattatggaacctgtttgccatcctagtatttacttaattgttccttcttaacatcaaagatggtcttctaggcaattgtaaattttaaattagccagttattttgacaattaattttttactccacctgtatctttagtgcccagccaatgatctggcatagttaggggtgcaccaagaatgtctgtaaactacctgaaggtttgtagatatggagtacaccttacccattaatcaagctgtgcatagcaggaaccaatacgagccgtgatcctcctggttcatacagaacaatggaaaaacataaggctttgtctacctagttggccatcagactttcagcaacttttatcatccagatagtcaccaaatgaaataaaatagaaaaatcccttgagcaatgaaacaattgtgaatgaacacaaagtccatgaatttaatccttatccgtttgctgagccaagcatgtgcatctgcagtgggtggcccaggctggcagcacagataccaccatttcccttttctttgctcagggcatggcctgtttatctcgttgcaccagatgagggttggaaggatgatggtggtggttgtttcagatctactgacagcaatgagaaatcaatgacagttgacaggaagagaggacgcatacaacaggcaaaagaggaatgcccagcagtcttggtccttgcggtgcaatactggccttgaggccaagtcagcaggggattcgtagtcactaacttctaactgaggcagggaagtaacatgttctggaaaaggtccaaagaaacaggaatagaggcagtgtagcaagaggcagatttttggtgccaaatagatttgaatcctggttctgcttcttcctttgtagagtatgatattggttctttcctcccaaagctattataaagactaaatatgtacacaaatctttgggatgtctgacatataaatgcttaacaataggtatttgctggtattattacaaatgaatttgcttatttttgagccacttctatgtctgtccattaaaccaaaatgtgttctgca

SEQ ID NO: 771 - DNA, 2962 bp, Homo sapiens
aaagggttgtagacatggcggccatcaggatgggaaaactgacaaccatgcctgcaggtctgatatatgcatctgtaagtgtacatgcagccaaacaagaggaatccaaaaagcagctagtgaaaccagagcagctccccatatatactgcaccaccgctccagtctaaatatgttgaagagcagcctggtcatttacaaatgggctttgcttccatccgcactgcaactggttgttacattggctggtgcaagggtgtttatgtctttgtgaaaaatgggataatggatacagtacaatttggaaaagatgcttatgtctatctgaagaatcctcctcgagattttcttccgaaaatgggagttattacagtttcaggattggcgggcttggtttcagcgagaaaaggttccaagtttaagaaaattacttatcctctgggactggccactttaggagcaactgtttgctacccagttcagtccgtaataattgctaaggtaacagcaaaaaggtatatgctacaagccagcaaatttttggagcagttaaatcattgtggacaaaaagcagcaaagaagagtcactccctaaacctaaagaaaactaagctaggatcctcttccgaaatagaagtacctgcaaaaacaactcacgtcttgaaacactcagtgcccttgccaacagaactcagctctgaagcaaagaccaaatcagaatccacttcaggtgcaacccagtttatgcctgaccccaagctcatggatcacgggcagtcccacccagaagatatagatatgtacagcactagaagctgaagtagactgcatgcagagactacacagaaaactacaagatgtgtggcgttgcaaataatgatgaaaataaatcatgtaatgggtaactgatacatagagtattacctaaaccaagtttctcccttacatttccaaatatgccatttgataaattacataagtggttaacacacaaactgtgaatgcagtgtaaacaatattaaatgattgatgaggagacttaggtagaagtattagcttgcatttgatgacctttaagggcacttaaaaaaaaatgaagacatgaattctagtgagattaaaatctaaaaatacatatatatatatgtatgtataaatacatacatatttatacatgtataaatacgtatttatacatatatgtatacatacatatttatacatatatgtataaatacatacatatttatacatatatgtatacatacatatttatacatataaacatatatttctgctctagctttcccagattaatgctagttaaattagaatggtgtatggaaaggtgtgtttccctctgtttttttttttttttttttttttttttttcccatttcctagagctggaataaaatatccatgttttatgggacttgagcttggctttgtcccttggttttgttaatgttaattcctcttaaatatctaaaaacatctctacctatttgagagggccatatgctacacaggcttcctaatactgcttagcaatccttctactggttcctaagtggtttactattgtgttccctggaagaggtattacaaacgttttattcttctcaagcctcttagaactgtcaaagttgactgtgcctcctatttcatagagaaaaaactaaattattagatatgaccattcccaaaacttcttcccatctaccttcaagacttacctcttttcagccatgcatcccccttttctaagacatgcttctctttgtgttcttgacctcattccttcccatctaagaccatattccaccctgtttaatttctagtcttcggtttctctttttacagtttctttcctccacctctacatagctgcaggtcttctctgtcttaaatcaacaataacaaaacaagacaaaaacctttccttaacttggcctcttcccttgaactattttttctctctccttcctataattgttatacttctttaaaaagtaattgttactttttgacaaaagtaaatattgtcccttttttccctactttcaagtcctctctgtcttgtgacattctggcctccatacctgcttaattttttttgagatggggtcttgctctgttgcccaggctggagtgcagtggcacaaacacagctcactgcaacctccacctcccaggatcaagcaatcctcccatctcaccctcccaagtagctgggactataggcacccgccaccatgcctaattttttgtatttttggtagtgacagggtttcaccatgttgtccaggctggtctcgaactcctgagctcaagcatctgtccgactcagcctaccacagtgttgggattacaggcgtgagccaccgcacccagcccctacttgaatttttatgtcattattgactcttcaccactctctccttgagactcacttatccctttgctctctatttttcctgcttttgttattcttcatttttcttctcttgctctgaatcccttaaatgctgaggctgctcaagtttcatccctagtcctattttctcattctatatgcacactcatttttcatttaacagacttcactggcttcaggcaccatttgttttattattcatattttcaacccccatatctctctagtgctgtagacctttatttctacttactagttatattcacctaacatcccatagatatgccaatgtcaatgtgcctaaaacaaaattgtctctacctcccgctccttcaaatctattctgtcttctctaatcctataattactctccctcaagtcatcatcatcacttttctgggttactgtaatagccttcaggctaatttgctcactgtcaatcttgctgtctctcatttcagaatatgttctgcttgcaggtgacagtaaactagttaaacaaatatttaatattagcttaagc

SEQ ID NO: 772 - DNA, 1279 bp, Homo sapiens
gtggggctgtcctaagggaagcctagtcgaactgatttgtccctctctgctctccgtctgaaaaccttggccgaaagggttgtagacatggcggccatcaggatgggaaaactgacaaccatgcctgcaggtctgatatatgcatctgtaagtgtacatgcagccaaacaagaggaatccaaaaagcagctagtgaaaccagagcagctccccatatatactgcaccaccgctccagtctaaatatgttgaagagcagcctggtcatttacaaatgggctttgcttccatccgcactgcaactggttgttacattggctggtgcaagggtgtttatgtctttgtgaaaaatgggataatggatacagtacaatttggaaaagatgcttatgtctatctgaagaatcctcctcgagattttcttccgaaaatgggagttattacagtttcaggattggcgggcttggtttcagcgagaaaaggttccaagtttaagaaaattacttatcctctgggactggccactttaggagcaactgtttgctacccagttcagtccgtaataattgctaaggtaacagcaaaaaaggtatatgctacaagccagcaaatttttggagcagttaaatcattgtggacaaaaagcagcaaagaagagtcactccctaaacctaaagaaaaaactaagctaggatcctcttccgaaatagaagtacctgcaaaaacaactcacgtcttgaaacactcagtgcccttgccaacagaactcagctctgaagcaaagaccaaatcagaatccacttcaggtgcaacccagtttatgcctgaccccaagctcatggatcacgggcagtcccacccagaagatatagatatgtacagcactagaagctgaagtagactgcatgcagagactacacagaaaactacaagatgtgtggcgttgcaaataatgatgaaaataaatcatgtaatgggtaactgatacatagagtattacctaaaccaagtttctcccttacatttccaaatatgccatttgataaattacataagtggttaacacacaaactgtgaatgcagtgtaaacaatattaaatgattgatgaggagacttaggtagaagtattagcttgcatttgatgacctttaagggcacttaaaaaaaaatgaagacatgaattctagtgagattaaaatctaaaaatacatatatatatatgtatgtataaatacatacatatttatacatgtataaatacgtatttatacatatatgt

SEQ ID NO: 773 - DNA, 5260 bp, Homo sapiens
atggctccactccgcgcgctgctgtcctacctgctgcctttgcactgtgcgctctgcgccgccgcgggcagccggaccccagagctgcacctctctggaaagctcagtgactatggtgtgacagtgccctgcagcacagactttcggggacgcttcctctcccacgtggtgtctggcccagcagcagcctctgcagggagcatggtagtggacacgccacccacactaccacgacactccagtcacctccgggtggctcgcagccctctgcacccaggagggaccctgtggcctggcagggtggggcgccactccctctacttcaatgtcactgttttcgggaaggaactgcacttgcgcctgcggcccaatcggaggttggtagtgccaggatcctcagtggagtggcaggaggattttcgggagctgttccggcagcccttacggcaggagtgtgtgtacactggaggtgtcactggaatgcctggggcagctgttgccatcagcaactgtgacggattggcgggcctcatccgcacagacagcaccgacttcttcattgagcctctggagcggggccagcaggagaaggaggccagcgggaggacacatgtggtgtaccgccgggaggccgtccagcaggagtgggcagaacctgacggggacctgcacaatgaagcctttggcctgggagaccttcccaacctgctgggcctggtgggggaccagctgggcgacacagagcggaagcggcggcatgccaagccaggcagctacagcatcgaggtgctgctggtggtggacgactcggtggttcgcttccatggcaaggagcatgtgcagaactatgtcctcaccctcatgaatatcgtagatgagatttaccacgatgagtccctgggggttcatataaatattgccctcgtccgcttgatcatggttggctaccgacagtccctgagcctgatcgagcgcgggaacccctcacgcagcctggagcaggtgtgtcgctgggcacactcccagcagcgccaggaccccagccacgctgagcaccatgaccacgttgtgttcctcacccggcaggactttgggccctcagggtatgcacccgtcactggcatgtgtcaccccctgaggagctgtgccctcaaccatgaggatggcttctcctcagccttcgtgatagctcatgagaccggccacgtgctcggcatggagcatgacggtcaggggaatggctgtgcagatgagaccagcctgggcagcgtcatggcgcccctggtgcaggctgccttccaccgcttccattggtcccgctgcagcaagctggagctcagccgctacctcccctcctacgactgcctcctcgatgacccctttgatcctgcctggccccagcccccagagctgcctgggatcaactactcaatggatgagcagtgccgctttgactttggcagtggctaccagacctgcttggcattcaggacctttgagccctgcaagcagctgtggtgcagccatcctgacaacccgtacttctgcaagaccaagaaggggcccccgctggatgggactgagtgtgcacccggcaagtggtgcttcaaaggtcactgcatctggaagtcgccggagcagacatatggccaggatggaggctggagctcctggaccaagtttgggtcatgttcgcggtcatgtgggggcggggtgcgatcccgcagccggagctgcaacaacccctccccagcctatggaggccgcctgtgcttagggcccatgttcgagtaccaggtctgcaacagcgaggagtgccctgggacctacgaggacttccgggcccagcagtgtgccaagcgcaactcctactatgtgcaccagaatgccaagcacagctgggtgccctacgagcctgacgatgacgcccagaagtgtgagctgatctgccagtcggcggacacgggggacgtggtgttcatgaaccaggtggttcacgatgggacacgctgcagctaccgggacccatacagcgtctgtgcgcgtggcgagtgtgtgcctgtcggctgtgacaaggaggtggggtccatgaaggcggatgacaagtgtggagtctgcgggggtgacaactcccactgcaggactgtgaaggggacgctgggcaaggcctccaagcaggcaggagctctcaagctggtgcagatcccagcaggtgccaggcacatccagattgaggcactggagaagtccccccaccgcattgtggtgaagaaccaggtcaccggcagcttcatcctcaaccccaagggcaaggaagccacaagccggaccttcaccgccatgggcctggagtgggaggatgcggtggaggatgccaaggaaagcctcaagaccagcgggcccctgcctgaagccattgccatcctggctctccccccaactgagggtggcccccgcagcagcctggcctacaagtacgtcatccatgaggacctgctgccccttatcgggagcaacaatgtgctcctggaggagatggacacctatgagtgggcgctcaagagctgggccccctgcagcaaggcctgtggaggagggatccagttcaccaaatacggctgccggcgcagacgagaccaccacatggtgcagcgacacctgtgtgaccacaagaagaggcccaagcccatccgccggcgctgcaaccagcacccgtgctctcagcctgtgtgggtgacggaggagtggggtgcctgcagccggagctgtgggaagctgggggtgcagacacgggggatacagtgcctgctgcccctctccaatggaacccacaaggtcatgccggccaaagcctgcgccggggaccggcctgaggcccgacggccctgtctccgagtgccctgcccagcccagtggaggctgggagcctggtcccagtgctctgccacctgtggagagggcatccagcagcggcaggtggtgtgcaggaccaacgccaacagcctcgggcattgcgagggggataggccagacactgtccaggtctgcagcctgcccgcctgtggaggaaatcaccagaactccacggtgagggccgatgtctgggaacttgggacgccagaggggcagtgggtgccacaatctgaacccctacatcccattaacaagatatcatcaacggagccctgcacgggagacaggtctgtcttctgccagatggaagtgctcgatcgctactgctccattcccggctaccaccggctctgctgtgtgtcctgcatcaagaaggcctcgggccccaaccctggcccagaccctggcccaacctcactgccccccttctccactcctggaagccccttaccaggaccccaggaccctgcagatgctgcagagcctcctggaaagccaacgggatcagaggaccatcagcatggccgagccacacagctcccaggagctctggatacaagctccccagggacccagcatccctttgcccctgagacaccaatccctggagcatcctggagcatctcccctaccacccccggggggctgccttggggctggactcagacacctacgccagtccctgaggacaaagggcaacctggagaagacctgagacatcccggcaccagcctccctgctgcctccccggtgacatgagctgtgccctgccatcccactggcacgtttacactctgtgtactgccccgtgactcccagctcagaggacacacatagcagggcaggcgcaagcacagacttcattttaaatcattcgccttcttctcgtttggggctgtgatgctctttaccccacaaagcggggtgggaggaagacaaagatcagggaaagccctaatcggagatacctcagcaagctgcccccggcgggactgaccctctcagggcccctgttggtctcccctgccaagaccagggtcaactattgctccctcctcacagaccctgggcctgggcaggtctgaatcccggctggtctgtagctagaagctgtcagggctgcctgccttcccggaactgtgaggacccctgtggaggccctgcatatttggcccctctccccagaaaggcaaagcagggccagggtaggtgggggactgttcacagccaggccgagaggaggggggcctgggaatgtggcatgaggcttcccagctgcagggctggagggggtggaacacaaggtgatcgcaggcccagctcctggaagccaagagctccatgcagttccaccagctgaggccaggcagcagaggccagtttgtctttgctggccagaagatggtgctcatggccatactctggccttgcagatgtcactagtgttacttctagtgactccagattacagactggccccccaatctcaccccagcccaccagagaagggggctcaggacaccctggaccccaagtcctcagcatccagggatttccaaactggcgctcactccctgactccaccaggatggcaacttcaattatcactctcagcctggaaggggactctgtgggacacagagggaacacgatttctcaggctgtcccttcaatcattgcccttctccgaagatcgctcctgctggagtcggacatcttcatcttctacctggctcaagctgggccagagtgtgtggttctcccaggggtggttggaccccaggactgaggaccagagtccactcatagcctggccctggagatgacaagggccacccaggccaagtgccccagggcagggtgccagcccctggcctggtgctggagtggggaagacacactcacccacggtgctgtaagggcctgagctgtgctcagctgccggccatgctacctccaagggacaggtaacagtcttagatcctctggctctcaggaagtggcagggggtcccaggacacctccggggtcttggaggatgtctcctaaactcctgccaggtgatagaggtgcttctcacttcttccttccccaaggcaaaggggctgttctgagccagcctggaggaacatgagtagtgggcccctggcctgcaacccctttggagagtggaggtcctggggggctccccgccctccccctgttgccctcccctccctgggatgctggggcacacgcggagtcattcctgtgagaaccagcctggcctgtgttaaactcttgtgccttggaaatccagatctttaaaattttatgtatttattaacatcgccattggaccccaaaa

SEQ ID NO: 774 - DNA, 5269 bp, Homo sapiens
atggctccactccgcgcgctgctgtcctacctgctgcctttgcactgtgcgctctgcgccgccgcgggcagccggaccccagagctgcacctctctggaaagctcagtgactatggtgtgacagtgccctgcagcacagactttcggggacgcttcctctcccacgtggtgtctggcccagcagcagcctctgcagggagcatggtagtggacacgccacccacactaccacgacactccagtcacctccgggtggctcgcagccctctgcacccaggagggaccctgtggcctggcagggtggggcgccactccctctacttcaatgtcactgttttcgggaaggaactgcacttgcgcctgcggcccaatcggaggttggtagtgccaggatcctcagtggagtggcaggaggattttcgggagctgttccggcagcccttacggcaggagtgtgtgtacactggaggtgtcactggaatgcctggggcagctgttgccatcagcaactgtgacggattggcgggcctcatccgcacagacagcaccgacttcttcattgagcctctggagcggggccagcaggagaaggaggccagcgggaggacacatgtggtgtaccgccgggaggccgtccagcaggagtgggcagaacctgacggggacctgcacaatgaagcctttggcctgggagaccttcccaacctgctgggcctggtgggggaccagctgggcgacacagagcggaagcggcggcatgccaagccaggcagctacagcatcgaggtgctgctggtggtggacgactcggtggttcgcttccatggcaaggagcatgtgcagaactatgtcctcaccctcatgaatatcgtagatgagatttaccacgatgagtccctgggggttcatataaatattgccctcgtccgcttgatcatggttggctaccgacagtccctgagcctgatcgagcgcgggaacccctcacgcagcctggagcaggtgtgtcgctgggcacactcccagcagcgccaggaccccagccacgctgagcaccatgaccacgttgtgttcctcacccggcaggactttgggccctcaggtatgcaagggtatgcacccgtcactggcatgtgtcaccccctgaggagctgtgccctcaaccatgaggatggcttctcctcagccttcgtgatagctcatgagaccggccacgtgctcggcatggagcatgacggtcaggggaatggctgtgcagatgagaccagcctgggcagcgtcatggcgcccctggtgcaggctgccttccaccgcttccattggtcccgctgcagcaagctggagctcagccgctacctcccctcctacgactgcctcctcgatgacccctttgatcctgcctggccccagcccccagagctgcctgggatcaactactcaatggatgagcagtgccgctttgactttggcagtggctaccagacctgcttggcattcaggacctttgagccctgcaagcagctgtggtgcagccatcctgacaacccgtacttctgcaagaccaagaaggggcccccgctggatgggactgagtgtgcacccggcaagtggtgcttcaaaggtcactgcatctggaagtcgccggagcagacatatggccaggatggaggctggagctcctggaccaagtttgggtcatgttcgcggtcatgtgggggcggggtgcgatcccgcagccggagctgcaacaacccctccccagcctatggaggccgcctgtgcttagggcccatgttcgagtaccaggtctgcaacagcgaggagtgccctgggacctacgaggacttccgggcccagcagtgtgccaagcgcaactcctactatgtgcaccagaatgccaagcacagctgggtgccctacgagcctgacgatgacgcccagaagtgtgagctgatctgccagtcggcggacacgggggacgtggtgttcatgaaccaggtggttcacgatgggacacgctgcagctaccgggacccatacagcgtctgtgcgcgtggcgagtgtgtgcctgtcggctgtgacaaggaggtggggtccatgaaggcggatgacaagtgtggagtctgcgggggtgacaactcccactgcaggactgtgaaggggacgctgggcaaggcctccaagcaggcaggagctctcaagctggtgcagatcccagcaggtgccaggcacatccagattgaggcactggagaagtccccccaccgcattgtggtgaagaaccaggtcaccggcagcttcatcctcaaccccaagggcaaggaagccacaagccggaccttcaccgccatgggcctggagtgggaggatgcggtggaggatgccaaggaaagcctcaagaccagcgggcccctgcctgaagccattgccatcctggctctccccccaactgagggtggcccccgcagcagcctggcctacaagtacgtcatccatgaggacctgctgccccttatcgggagcaacaatgtgctcctggaggagatggacacctatgagtgggcgctcaagagctgggccccctgcagcaaggcctgtggaggagggatccagttcaccaaatacggctgccggcgcagacgagaccaccacatggtgcagcgacacctgtgtgaccacaagaagaggcccaagcccatccgccggcgctgcaaccagcacccgtgctctcagcctgtgtgggtgacggaggagtggggtgcctgcagccggagctgtgggaagctgggggtgcagacacgggggatacagtgcctgctgcccctctccaatggaacccacaaggtcatgccggccaaagcctgcgccggggaccggcctgaggcccgacggccctgtctccgagtgccctgcccagcccagtggaggctgggagcctggtcccagtgctctgccacctgtggagagggcatccagcagcggcaggtggtgtgcaggaccaacgccaacagcctcgggcattgcgagggggataggccagacactgtccaggtctgcagcctgcccgcctgtggaggaaatcaccagaactccacggtgagggccgatgtctgggaacttgggacgccagaggggcagtgggtgccacaatctgaacccctacatcccattaacaagatatcatcaacggagccctgcacgggagacaggtctgtcttctgccagatggaagtgctcgatcgctactgctccattcccggctaccaccggctctgctgtgtgtcctgcatcaagaaggcctcgggccccaaccctggcccagaccctggcccaacctcactgccccccttctccactcctggaagccccttaccaggaccccaggaccctgcagatgctgcagagcctcctggaaagccaacgggatcagaggaccatcagcatggccgagccacacagctcccaggagctctggatacaagctccccagggacccagcatccctttgcccctgagacaccaatccctggagcatcctggagcatctcccctaccacccccggggggctgccttggggctggactcagacacctacgccagtccctgaggacaaagggcaacctggagaagacctgagacatcccggcaccagcctccctgctgcctccccggtgacatgagctgtgccctgccatcccactggcacgtttacactctgtgtactgccccgtgactcccagctcagaggacacacatagcagggcaggcgcaagcacagacttcattttaaatcattcgccttcttctcgtttggggctgtgatgctctttaccccacaaagcggggtgggaggaagacaaagatcagggaaagccctaatcggagatacctcagcaagctgcccccggcgggactgaccctctcagggcccctgttggtctcccctgccaagaccagggtcaactattgctccctcctcacagaccctgggcctgggcaggtctgaatcccggctggtctgtagctagaagctgtcagggctgcctgccttcccggaactgtgaggacccctgtggaggccctgcatatttggcccctctccccagaaaggcaaagcagggccagggtaggtgggggactgttcacagccaggccgagaggaggggggcctgggaatgtggcatgaggcttcccagctgcagggctggagggggtggaacacaaggtgatcgcaggcccagctcctggaagccaagagctccatgcagttccaccagctgaggccaggcagcagaggccagtttgtctttgctggccagaagatggtgctcatggccatactctggccttgcagatgtcactagtgttacttctagtgactccagattacagactggccccccaatctcaccccagcccaccagagaagggggctcaggacaccctggaccccaagtcctcagcatccagggatttccaaactggcgctcactccctgactccaccaggatggcaacttcaattatcactctcagcctggaaggggactctgtgggacacagagggaacacgatttctcaggctgtcccttcaatcattgcccttctccgaagatcgctcctgctggagtcggacatcttcatcttctacctggctcaagctgggccagagtgtgtggttctcccaggggtggttggaccccaggactgaggaccagagtccactcatagcctggccctggagatgacaagggccacccaggccaagtgccccagggcagggtgccagcccctggcctggtgctggagtggggaagacacactcacccacggtgctgtaagggcctgagctgtgctcagctgccggccatgctacctccaagggacaggtaacagtcttagatcctctggctctcaggaagtggcagggggtcccaggacacctccggggtcttggaggatgtctcctaaactcctgccaggtgatagaggtgcttctcacttcttccttccccaaggcaaaggggctgttctgagccagcctggaggaacatgagtagtgggcccctggcctgcaacccctttggagagtggaggtcctggggggctccccgccctccccctgttgccctcccctccctgggatgctggggcacacgcggagtcattcctgtgagaaccagcctggcctgtgttaaactcttgtgccttggaaatccagatctttaaaattttatgtatttattaacatcgccattggaccccaaaa

SEQ ID NO: 775 - DNA, 2477 bp, Homo sapiens
acaacgagctcgggcctcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcaggtggggcccggctttgcagtgggcacagtgggggggccacttctcagaggttcagctctacagccttagcctgtgctcccagcagaatccagttccccatgggcttagctgggctttcccagtgccctccgccactctcagagatgacattgtcattccgcctggttgatttccctttggacattctcagcaaattctgggctcagtctttttgatcgccacttctttgtggaagccctgccaggtcaagaagttttccctcttttgtggtgaggaggacacaggcctgggaaaaataggaacagagttcttgtcctttagtcccagctctcagaatcctcgctgtgtttcctcaggcagcatggctccgcctctctgagcctctgtctctgcttctgaacagcggggccaataatgatgccccgatgccttcctggaagttcagtgagggaaagtcagttgagggacacaaaagtgttttgtaaactataaagtacgtggcatgtgtaggtgaattacaggggccatggatgtggacaccatggagggggaagtggagcgttttcagtggagttggctcctccccgcactgagccatgttcctatgtcaggtggcagcggggaagcgagggtccaatcctgccctgcgctagtcctcatctgagtctcagcctgggtcccccatggttttagcaacacgggtggcaagcagatcaaccaggtggcattggaggcgtggcgcagccggcgggaccgcgaggagatcctcctgcaggagctggagccggtcatctcccgcgcggtgctggacaacccgcaccgtgagtctggctcagcagccccctcccgggcagcttcaccccacacccaggggccaggctctcccggggtctcatgctttgcccactgacccggcagttctgagcctggctttggcactcccagctttgtgactttgggtgagccttacagcccctgagtcctacacccagaaggcggctgagggaactgaggccagcatttttcctcctgcccctgggggtttggggccggcttctcccctcttgtgaagcacaaagtcccctccccacctacccttcctgcagatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccag

SEQ ID NO: 776 - DNA, 1523 bp, Homo sapiens
cgggcgaggcagttgactgccccacaacgagctcgggcctcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagcaacacgggtggcaagcagatcaaccaggtggcattggaggcgtggcgcagccggcgggaccgcgaggagatcctcctgcaggagctggagccggtcatctcccgcgcggtgctggacaacccgcaccatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccaga

SEQ ID NO: 777 - DNA, 2575 bp, Homo sapiens
aaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttgtattacttgagtctaagggtagatcacagactgtgtggtctcaactgaaaggatcacccttggcatctgtgtgcctggattcttccagaatgtctacaatgctaatctctcacatagaggttcccagcttcttaagaaccccttttggcacctaatcaaatttcaaaatccctccccccacattttcatacttttccccattctcaggacttttcaccatccatcacccacttatcccttcatttgacaccattcattaagtgccttctgtgtgtcagtccctggccactcactgcagttcaaggccccctttccgctctgctgtactcctcgcctacctactccttgccttttctgtcgcacagccccttctttccaggcgagattcctcagcttctgagtaggaaacactccgggctccaggtttctggttgggaagggaaggccaggccaaaagctccaccggccgtatagataatgtactcgcagttttgtatcttccattcatactttaacctacaggtcatttgagtcttcacacaaataataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgct

SEQ ID NO: 778 - DNA, 3707 bp, Homo sapiens
ggggcctgccgaggccgccaaagcgggctgggcgggaggggccaggccagctggggccggagctcgtgtgacatcaccgggcggcccgcctctgtctggggctgaggggaggcccggagcctttctggggcctgggggatcctcttgcactggtgggtggagagaagcgcctgcagccaaccagggtcaggctgtgctcacagtttcctctggcggcatgtaaaggctccacaaaggagttgggagttcaaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggctttcatagattctattcacaaagaataaccaccattttgcaaggaccatgaggccactgtgcgtgacatgctggtggctcggactgctggctgccatgggagctgttgcaggccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttgtattacttgagtctaagggtagatcacagactgtgtggtctcaactgaaaggatcacccttggcatctgtgtgcctggattcttccagaatgtctacaatgctaatctctcacatagaggttcccagcttcttaagaaccccttttggcacctaatcaaatttcaaaatccctccccccacattttcatacttttccccattctcaggacttttcaccatccatcacccacttatcccttcatttgacaccattcattaagtgccttctgtgtgtcagtccctggccactcactgcagttcaaggccccctttccgctctgctgtactcctcgcctacctactccttgccttttctgtcgcacagccccttctttccaggcgagattcctcagcttctgagtaggaaacactccgggctccaggtttctggttgggaagggaaggccaggccaaaagctccaccggccgtatagataatgtactcgcagttttgtatcttccattcatactttaacctacaggtcatttgagtcttcacacaaataataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgctatttggatgtatctaca

SEQ ID NO: 779 - DNA, 6425 bp, Homo sapiens
atggccgctgccgccctcccgccccggccgctgctccttctgccgctagtgctgctgctgagcggccgccccacgcgcgccgacagtaaggtgtttggggacctggaccaggtgaggatgacctcggagggctccgactgccgttgcaagtgcatcatgcggcccctgagcaaggacgcgtgtagccgagtgcgcagtgggcgggcacgcgtggaggacttctacacggtggagactgtgagctcgggcactgactgccgctgctcctgtaccgcacctccctcctctctcaacccctgtgagaacgagtggaagatggagaaactcaaaaagcaggcgcccgagctcctcaagctgcagtccatggtggatctcctggagggcaccctgtacagcatggacttgatgaaggtgcacgcctacgtccacaaggtggcctcccagatgaacacactggaagagagcatcaaggccaacctgagccgggagaatgaggtggtgaaggacagcgtgcgccacctcagtgagcagttgaggcactatgagaatcactctgccatcatgctgggcatcaagaaggagctgtcccgcctgggcctccagctgctgcagaaggatgccgccgccgcccctgccacccctgccacgggcactggtagcaaggcccaggacacagctagaggaaaaggcaaggacatcagcaagtatggcagtgtgcagaaaagctttgcagacagaggcctcccaaaacctcccaaggagaagctgcttcaggtggagaagctgagaaaggagagcggcaagggcagtttcctccagcccacagccaagccccgcgccctggcccagcagcaggctgtgatccggggcttcacctactacaaggcaggcaagcaggaggtgaccgaggcggtggcagacaacaccctccagggcacttcctggctggagcaactgccgcccaaggtggagggcaggtccaactccgcagagcccaactccgcagagcaggatgaggctgagcccaggtcctccgagcgagtggacctggcttctggcacccccacttcaatccctgccaccaccaccaccgccaccaccaccccaacccccaccaccagtctcctgcccaccgagccaccttcaggtccagaagtctccagccaaggcagagaggcgagctgtgagggcaccctccgggctgtggacccccctgtgaggcaccacagctatgggcgccacgagggagcctggatgaaggaccctgcagctcgagacgacaggatctatgtcaccaactactactatggaaacagcctggtggagttccgcaacctggaaaacttcaagcaaggccgctggagtaacatgtacaagctaccctacaactggatcggcacaggccacgtggtgtaccagggcgccttctactacaaccgcgccttcaccaagaacatcatcaagtacgacctacggcagcgcttcgtggcctcctgggcgctgctgcccgacgtggtatatgaggacaccacaccttggaagtggcgcggacactcggacattgactttgccgtggacgagagcggcctgtgggtcatctaccccgccgtggacgaccgcgatgaggcccagcccgaggtgatcgtcctgagtcgcttggaccccggcgatctctccgtgcaccgggagaccacgtggaagacacggctgcggcggaactcctacgggaactgcttcctggtgtgcggcatcctgtatgccgtggacacgtacaaccagcaggaaggccaggtcgcctacgctttcgacacgcacacgggcaccgacgcacgcccccagctgccgttcctcaacgagcacgcctacaccacccagatcgactacaaccccaaggagcgggtgctgtacgcctgggacaatggccaccagctcacctacaccctccacttcgtggtctgagtggagacctgtgctccccggagaggggcagcagtgcgggaggggctttgcacagcagctcctgcaactgacccagtccgcaaatatttattgggggccagcccagggctgggactgggcatgaggtggtcaccaggattgagcttcctcagcacccagtgggtaatacttgcttccacttgcagagcaccgtgccaagcacttcccacacacttacccgtttgattctcctagcacctcccttggaggtagagatcatgaacccatttaacagacgaggagacaggctcagagaggcaccgtcccttgcctaacacctcagttgtgatcaggcaggctgtgctctcaggacagccccattttagggatgaggagacttcaccacgccctcccctccctgccctcccccatctccccggtctcccttgttctctcaacccagtctcccttcccagggccactcagaaccagaggtctttagggccagtgtactggtgtggggtggaggccctggctctgcctgccatcctagggccctgttctggctgagctgttggtggccctgggctttgggccccttagccaatgtccttgtctcttgtctttggccagccccctcagcccagcccaccccacccgctgtccggccacattccaaacctctaccgtcacctagctgctgagcagaaaccgcaccccgagagaaaatcccatcctctgttccaaggcccctgtctgctctatgctcatttttattttctcttattcttcatcagtgccgtcatttgtttctgcagcagcagctgagaaggcagccggcagctctgccagggtggggagctgagctgaggctccctctccacccagaagcactggcgttgttcacatagtcaggccttgggtcccctccctggttcatcccagagcctttgggcctggagtccgccttgtcctttttctctgggctttcaaacccacaacctttacacactcagggatacctccgggtctgccatgaataagaccctaggcccaagtctggtgtggtgccaggatggcacagtttccctcttccttgccagccctgacctggtcactgggcaggctggcccagcagcctgggggctgcagaagacatggtgtgagtagttgggtccaggggaggcatcaggccttcttctggttgcaggagagaaccagagggtgggaacggggagggaagaactgagggtctgcagactggacttttcctggctcgacccaggacttgggttgaggatgcacgggggccaccttgcccggggccactggtggctccccagagcctcagacccacacagcccagaggacgaggccttcaagcctgcccctcttctgcttttttagacagtatttttagagctggaaagaaattttctagcccaactccctgtttcatgaaagagaaaagaggctcagaaaagtttagagagcagctcagtgtcacactgggagctgggcacagccgatctccttccagaagggttctgtctgtatcctttattctccgcacatggaggctgccctacctgggaaggcaccccagcacctgtgaaggacatttactgctcatcctcacctgccccctggcccttgctgccttcattctgtcccaatgccagctccctggatgtctgtatgtttgaataccagttgccatgttaggaaggtcagctgcacagccaagagtgtaagagtgtaaagaaatgcctttttttttttttttgagttggagttttgctcttgtcgcccaggctggagtgcagtggcgcgatctcggctcactgcaacctctgccccctgggttcaagcgattctcctgcctcagcctccctagtagctgggactacagcacccaccaccacacccagctaatttttgtatttttagtagagacaggggtttcaccacgttggccaggctggtctcgaactcctgaccttaggtgatccgcccgcctcagcctcccaaagtgttgggattacaggcatgagccactgcgcctggccagcaaatgctttttgtgcagaatacacttctttcaggcattgtcaggtgctgttttgtttaagctctaactcacccctggaatacaggggaatgatgacaaccagcccagccaggcctgactcatcatggtcacatccagcccccacccccggccaactaaccactgcaggctcctcttccagactcaccagggggcctcgaggccccggcatctcccttggccctgggtgtgggttttacaagactgtgtctttcatgacatcatagcccaaccatgtgagaagaaggagaaggcccccctttcttcattaatctgaaaaaaaggaaagtgagaataggctgatttttaaaagttaaggggcaagcagcattgcattctgggggaacgatcctggccacagccgccaaacaaacattcactaggcctcttctgttttcatacccttgtaagtgggttatgtggtgggtatggtcagttttttcttttttcttttcttttcttttttttgagacagagtttcgcttttgttgcccgggctggaatgcaatggcgcgattcagctcactgcaatctccgcctcccgggttcaagtgattctcctgccttagcctcctgaaaagctgggattacagggccctgccaccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattggcgcctagaacagttaggtcgctcgtcacataggcagttaagtggagaaccaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacacttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgattt

SEQ ID NO: 780 - DNA, 5012 bp, Homo sapiens
gtgccgggaagtggctccagggagaagaggcctcttccctcacccgctgtgggagctgcgccccgaaagcctgccccggcacgtcgggctctcctgacccgccaagaccagagagccgttggcgccctccgcccgggcctgccggtccgtttattttaagaagctttgtgcgcctgctgtggggatttctgatccaggctgcgaagaatttcgaagtctggaaaatagcaactgtgtttgtttctaaaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagaccgagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccagggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgcctta

SEQ ID NO: 781 - DNA, 4854 bp, Homo sapiens
gaggcgggagcaggcggctggccggcagcagttactcggggtttccggtgcgaggccagaggtggggaagccatcggacgtcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagaccgagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccagggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgcctta

SEQ ID NO: 782 - DNA, 2190 bp, Homo sapiens
cctgggtgcaaccagtcacagctctgcagaggttactgtgattttgcccctgaaggatctgtccacaacttaggaactcacacagcttttggcctgagcccccgttaccaagagaaaggaggtttttgccaaggactccaaggggagtgcacttgatgctggtcgggacccaaagcgcccagccctccctgagacattgtgtgagtcgggctgggcctcaaacacggcccccactgccccaccccagccagggtggtgcttgtgtgggaaggactttaaatccagctgccagacccctggacgggagaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtactccttcttccctagcaacggggattccggctttcttggtaacagaggtctcaggctccctggcaaccaaggctctgcctgctgtggaaacccaggccccaacttccttagcaacgaaagacccgccctccatggcaacagaggctccaccttgcgtaacaactgaggtcccttccattttggcagctcacagcctgccctccttggatgaggagccagttaccttccccaaatcgacccatgttcctatcccaaaatcagcagacaaagtgacagacaaaacaaaagtgccctctaggagcccagagaactctctggaccccaagatgtccctgacaggggcaagggaactcctaccccatgcccaggaggaggctgaggctgaggctgagttgcctccttccagtgaggtcttggcctcagtttttccagcccaggacaagccaggtgagctgcaggccacactggaccacacggggcacacctcctccaagtccctgcccaatttccccaatacctctgccaccgctaatgccacgggtgggcgtgccctggctctgcagtcgtccttgccaggtgcagagggccctgacaagcctagcgtcgtgtcagggctgaactcgggccctggtcatgtgtggggccctctcctgggactactgctcctgcctcctctggtgttggctggaatcttctgaaggggataccactcaaagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacctgtggcaa

SEQ ID NO: 783 - DNA, 573 bp, Homo sapiens
acacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggagctcaaggagtcttgcatccggaaccaggactgcgagactggctgctgccaacgtgctccagacaattgcgagtcgcactgcgcggagaaggggtccgagggcagtctgtgtcaaacgcaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcctagtgctccctccttcttgctgcctcctcctcctccacctgctctcctccctacccagagctctgtgttcaccctgttccccagagcctccaccatgagtggagggaagtggggagtgattgaaataaagagctttttcaatgtt

SEQ ID NO: 784 - DNA, 602 bp, Homo sapiens
ttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggagctcaaggagtcttgcatccggaaccaggactgcgagactggctgctgccaacgtgctccagacaattgcgagtcgcactgcgcggagaaggggtccgagggcagtctgtgtcaaacgcaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtt

SEQ ID NO: 785 - DNA, 1548 bp, Homo sapiens
gacgccttggaggacttggaacacctgtaacaggacaaggagttctgctcaggcacgtggccacagaaaactacttaggaagcctgtggtgagaacaacaacagtgcctgagaatcccacggctctggggaagtgagccccgaggatgaggctgctcgcctggctgattttcctggctaactggggaggtgccagggctgaaccagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggtcaggagtcctgcggaggccagaggaggagggtgggaggggcttaaatgcatcaccaccttccctcactctcagcttatccaccttcccctgaccactgagcctcaggaaggttgagctccttccacccttctccagctcaggatcagaaccctggaggcacctgccaccgagtcagggcagtgcctcaccaagtcaccttttcccctggatgactgtcacagcttcatacctggtctccctgcctctggccctgccctgctatggcccatccgctacacaagagagaagaaactaatctcctatagcaccactttcatcttgtctccgtcctgctcaaaaaccttcagtggctccccagtgccttcaagataaagttgtgtctccttgacctagta

SEQ ID NO: 786 - DNA, 1955 bp, Homo sapiens
ataccctgctgggcaaaggaggaagagccagaggatccagacgccttggaggacttggaacacctgtaacaggacaaggagttctgctcaggcacgtggccacagaaaactacttaggaagcctgtggtgagaacaacaacagtgcctgagaatcccacggctctggggaagtgagccccgaggatgaggctgctcgcctggctgattttcctggctaactggggaggtgccagggctgaaccagaggaagcgcaaggaccatgtgcccaagagaaaggcaaagggcctcccccaacatccatcctggccagcctggctccgggcttggaagcagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggacatggtgacctacttcatgaacctgagccaggcgaatgctcaggggacgccgcgctgggagctcgagtaccagctgaccgaggcctatggggtgccggacgccagcgcccactccatgcacacagtgctggaccgcatcgctggcgaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccgcgcctgaggagtgaactgaaataggacaaccgaatcaggaagcgaagccccaggagctgcagccatccgtgatcgcgccactgcactccagcctgggtgacaaagccagactctctccaaaaacaaaccagaaacagaaaagaaatgacgacccaagacccccctacaagcatacttcttttgcgtattatgtttaactcacaaaacaaagctcatcatgcgtttg

SEQ ID NO: 787 - DNA, 1878 bp, Homo sapiens
ccagatcataccctgctgggcaaaggaggaagagccagaggatccagacgccttggaggacttggaacacctgtaacaggacaaggagttctgctcaggcacgtggccacagaaaactacttaggaagcctgtggtgagaacaacaacagtgcctgagaatcccacggctctggggaagtgagccccgaggatgaggctgctcgcctggctgattttcctggctaactggggaggtgccagggctgaaccagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggacatggtgacctacttcatgaacctgagccaggcgaatgctcaggggacgccgcgctgggagctcgagtaccagctgaccgaggcctatggggtgccggacgccagcgcccactccatgcacacagtgctggaccgcatcgctggcgaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccgcgcctgaggagtgaactgaaataggacaaccgaatcaggaagcgaagccccaggagctgcagccatccgtgatcgcgccactgcactccagcctgggtgacaaagccagactctctccaaaaacaaaccagaaacagaaaagaaatgacgacccaagacccccctacaagcatacttcttttgcgtattatgtttaactcacaaaacaaagctcatcatgcgtttgattctg

SEQ ID NO: 788 - DNA, 2080 bp, Homo sapiens
gggccagggacgaccctgtcagctgcagccccagaggtccggggcgcgcagccgggtcccctcgagggcgcagccggccgccccgccccgcccctcgaagcagccgggccgggcgcgcagtgggctacaaactttcgcggcgcgagtccgccaaggcagcgcgccgactcgggctcggctcggctctgcgctgctccggacggctgtgaccgctggccgggggctcgggccgccggtacccacggaccgcgcgcccgggtgcctgctccgctaagcccctcgccccgcgcggacctcggtatccagcgccctgctgcccgggctctccccgcgcgccctactgccgcgaggtcagtccgcagcctccggtgcgccagcgctcgccttcctcctcctggacttcggccctttgccgccctcaccacgccatggccctggcgcccccaccgcgcggcctgtggcaggccaaggacatctcccccatcgtcaaggcggcccgccgggatggcgagctgctcctctccgcccagctggattctgaggagagggacccgggggtgccccggcccagcccctatgcgccctacatcctagtctatgccaacgatctggccatctcggagcccaacagcgtggcagtgacgctgcagagatacgaccccttccctgccggagaccccgagccccgcgcagcccccaacaactcagcggacccccgcgtgcgccgagccgcgcaggccactgggcccctccaggacaacgagctgccggggctggatgagaggccgccgcgcgcccacgcacagcacttccacaagcaccagctgtggcccagccccttccgggcgctgaaaccccggccagggcgcaaagaccgcaggaagaagggccaggaggtgttcatggccgcctcgcaggtgctggactttgacgagaagacgatgcagaaagcccggaggaagcagtgggatgagccgagggtgtgctcccggaggtacctgaaggtggacttcgcagacatcggctggaatgaatggataatctcaccgaaatcttttgatgcctactactgcgcgggagcatgtgagttccccatgcctaagatcgttcgtccatccaaccatgccaccatccagagcattgtcagggctgtgggcatcatccctggcatcccagagccctgctgtgttcccgataagatgaactcccttggggtcctcttcctggatgagaatcggaatgtggttctgaaggtgtaccccaacatgtccgtggacacctgtgcctgccggtgagaccactccagggtggaaagaagccacgcccagcagagctgccttctcggagccttctgcaaccaggacttgtggtgcagctgcagacacagagcacagctcatgggcaacatcactggggcccagagagagctgtccgccagtgcatcattagggggtctttcattgctagtgactagccccttaaatgccagcctgagtacctgaaggaatctgggaattagccctggcctgaaagtggcccatcattcatacccactgttctgaaggcttgaaaacaaaacatatccacaacattggcttgatgtgatcatcatctcataactgagcaagaagactatgcaaatcttagggcgctcgctccctgcacacggaaagaactctgtttaaatgctcagttcagaacactttgggccacatagtgattttggaaaacaggataatcgtggtgtaaatgagtgtttcctttcaaagtccactgcagagcttttatccatatggtatgcacatgtagccaatattggtttctttttcttaatatatatattttattttaaaacaacaaaaagggagggcgttgacaccattccccacagagatagtcatgctgagtgtgggttgtttaaacatgcatattgaaataacacatatagtaacgtgggaatactaaaaaataaccaagattttatatttttgtaaattatactttctatactgtagattgtgtatgttatgtgtttttatggaaagctaataaattaaaggtacagtggtatcttgaaaaa

SEQ ID NO: 789 - DNA, 1802 bp, Homo sapiens
gcagtggcgcggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcatattttggt

SEQ ID NO: 790 - DNA, 1912 bp, Homo sapiens
gcaggcgcagtggcgcggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 791 - DNA, 497 bp, Homo sapiens
gagatgaggtcttgctatgttgcccaggctggtctcaaactcccgggctcaagcgatcctcccgcctcggcctctcaaagcactaggattacagcctcaggctatggcccaccttcctctcgcccttccagccgcgttgtcaatggtgaggatgcggtcccctacagctggccctggcaggtttccctgcagtatgagaaaagcggaagcttctaccacacctgtggcggtagcctcatcgcccccgactgggttgtgactgccggccactgcatctcgagctcccggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtga

SEQ ID NO: 792 - DNA, 3663 bp, Homo sapiens
atgcccggcttgctgaattggatcacgggggcagccctgcccctcaccgcgtctgatgttacctcctgtgtcagcggttatgccctgggcctaactgcctccctcacctatggcaacctggaagcccagcccttccagggcctcttcgtgtaccccctggatgagtgcaccacggtgatcggctttgaggcagtcattgccgaccgtgtcgtgacagtacagatcaaggacaaagccaagctggagagcggccacttcgatgcctcccatgttcgatccccaacagtcacagggaacattctgcaagacggggtttccatagcccctcattcctgcacaccgggaaaggtgaccttggacgaggatttggagcggatcctgttcgtggccaacctggggaccattgcccccatggagaatgtcaccatcttcatcagcacctcctcggagctcccaacgctgcccagcggggctgtgagggtccttctgcctgctgtctgtgccccaaccgtgccccagttctgcaccaagagcactggcacctccaaccaacaggcccagggcaaagacaggcactgcttcggtgcctgggccccgggctcctggaataagttgtgcctggcgactctcctgaacaccgaagtgtccaaccccatggagtatgagttcaacttccagctggagatccgtgggccatgtctgctcgcaggggtggagagtcccactcatgagattcgtgccgacgccgccccatctgcccgctcggccaagagcatcatcatcaccttggccaacaagcacacctttgaccggcctgtggagatcctcatccaccccagcgagccccatatgccccatgtcctgatagagaaaggggacatgaccctgggagagtttgaccagcacttgaagggaagaacagatttcattaaagggatgaagaagaagagcagagcagagcggaagacagaaatcattcgaaaacgcctccacaaagacattccccaccactccgtcatcatgctcaacttctgtcccgacctccagtcagtccagccgtgcctgagaaaggcccacggggagttcatcttcctcattgacaggagcagcagcatgagcgggatcagcatgcaccgagtcaaggatgccatgttggtggcccttaagagcctcatgccagcctgcctcttcaatatcattgggtttggatccacatttaagagcctttttccttccagccagacctacagtgaggacagcttggccatggcttgtgatgacatccagagaatgaaggccgacatgggtgggaccaacatcctttcccctctcaagtgggtcatcaggcagccagtgcaccgaggccacccgcggctcctcttcgtgatcacagatggcgctgtcaacaacacagggaaggtgctggagctggtgcgaaatcacgccttctccaccaggtgctatagctttggaattggacccaacgtctgccacagactggtgaaaggactggcatctgtgtccgagggcagtgctgagctcctgatggagggggagcggctgcaacccaagatggtcaaatccttgaagaaggccatggccccagtcctgagcgatgtgactgtggagtggatcttccctgagaccactgaggtcctggtctcacccgtcagcgccagctccctcttccctggagaacggctggtggggtatggcattgtatgtgatgcttctttgcacatctccaatcccagatctgacaagaggcgccggtacagcatgctgcactctcaggagtctggcagctctgtcttctaccactctcaggatgacggacccgggctggaaggtggagactgtgccaagaactcgggggcacccttcatcctagggcaggccaaaaatgcccggctagccagcggagactctaccaccaagcacgatctgaacctctctcagcgacggagggcatacagcaccaaccagatcaccaatcacaagcccctcccaagagccaccatggcaagtgaccccatgccagctgccaagagatacccactgcggaaagccaggctgcaggacctcaccaaccagaccagcctggatgtccagcggtggcagattgatttgcagcccttgctgaacagtggtcaggacctgaaccagggccccaaactccgtggcccaggggcccgaaggccctctctgctgccccaaggctgccagcccttcctgccctggggccaggagacccaggcctggagccctgtgagagagcggacttctgacagccgaagccctggagatctggagccgtcccaccatccctctgccttcgagacagagacgtcctcggactgggaccccccagccgagtcccaggagcgagccagtcccagcaggcccgccaccccggccccggtgctgggcaaggccctggtcaaaggcctgcacgacagccaacgcctgcagtgggaggtgagcttcgagctggggacccctggaccggagcggggcggcgcgcaggatgccgacctatggagcgagaccttccaccacctggcggcccgcgccatcatccgcgacttcgagcagctggcggagcgcgagggcgagatcgagcaggggtccaaccgccgctaccaagtgagcgccttgcacaccagcaaggcctgcaacatcattagcaaatacacagccttcgtgcctgtggacgtgagcaagagccggtacctgcccaccgtggtggagtaccccaactctgctgccctgcgtatgcttggctctcgggccctggcccaacagtggaggggcacctcttctggctttggaaggccgcagacgatgcttggagaagattcggcaccaggaaatggtaaatttcaggccctaaacatggaggcaagtcccactgctctcttcagcgaggccaggtcccccggccgcgagaagcacggtgcttctgaaggtccccagcgcagcctggctacaaatactctttcttccatgaaggcctcagagaatctctttggatcctggctaaatctcaacaagtccaggctactgacgcgagcagccaagggcttcctgagcaagccactgatcaaagctgtggagtcgacctccgggaaccagagcttcgactacatacctctggtgtctctgcagctggcctccggagccttcctgctcaacgaagccttctgtgaggccacgcacatccccatggagaagctcaagtggacgtcccccttcacctgccatcgagtgtccctcaccacccgcccgtctgagtccaagaccccgagtccccagctgtgcaccagctccccgcctaggcacccgtcctgtgacagcttctccctggagcctctggccaagggcaagctgggcctggagccgagggcagtggtggagcacactgggaagctgtgggccacggtggtggggctggcatggctggagcacagttcggcctcctacttcactgagtgggagttggtggctgccaaggccaactcatggctggagcagcaggaagtacccgagggccgcacgcagggcacactcaaggccgctgcccgccagctgtttgtgcttctgcggcactgggatgagaatctcgagttcaatatgctctgctataacccgaattatgtgtag

SEQ ID NO: 793 - DNA, 3247 bp, Homo sapiens
atcgcaatgtgggcattgatcaagccagctgccagggcagcgggcgcagggcttgggcactggagcccagccccggaccgcacctccagcagtgctgggtgcagaaggcagtcactgtggcagtggagagacagagtgtgtacccagacacgtgttgcttctggggtaaggttctgaaggctgagtagccagcgggatgcccggcttgctgaattggatcacgggggcagccctgcccctcaccgcgtctgatgttacctcctgtgtcagcggttatgccctgggcctaactgcctccctcacctatggcaacctggaagcccagcccttccagggcctcttcgtgtaccccctggatgagtgcaccacggtgatcggctttgaggcagtcattgccgaccgtgtcgtgacagtacagatcaaggacaaagccaagctggagagcggccacttcgatgcctcccatgttcgatccccaacagtcacagggaacattctgcaagacggggtttccatagcccctcattcctgcacaccgggaaaggtgaccttggacgaggatttggagcggatcctgttcgtggccaacctggggaccattgcccccatggagaatgtcaccatcttcatcagcacctcctcggagctcccaacgctgcccagcggggctgtgagggtccttctgcctgctgtctgtgccccaaccgtgccccagttctgcaccaagagcactggcacctccaaccaacaggcccagggcaaagacaggcactgcttcggtgcctgggccccgggctcctggaataagttgtgcctggcgactctcctgaacaccgaagtgtccaaccccatggagtatgagttcaacttccagctggagatccgtgggccatgtctgctcgcaggggtggagagtcccactcatgagattcgtgccgacgccgccccatctgcccgctcggccaagagcatcatcatcaccttggccaacaagcacacctttgaccggcctgtggagatcctcatccaccccagcgagccccatatgccccatgtcctgatagagaaaggggacatgaccctgggagagtttgaccagcacttgaagggaagaacagatttcattaaagggatgaagaagaagagcagagcagagcggaagacagaaatcattcgaaaacgcctccacaaagacattccccaccactccgtcatcatgctcaacttctgtcccgacctccagtcagtccagccgtgcctgagaaaggcccacggggagttcatcttcctcattgacaggagcagcagcatgagcgggatcagcatgcaccgagtcaaggatgccatgttggtggcccttaagagcctcatgccagcctgcctcttcaatatcattgggtttggatccacatttaagagcctttttccttccagccagacctacagtgaggacagcttggccatggcttgtgatgacatccagagaatgaaggccgacatgggtgggaccaacatcctttcccctctcaagtgggtcatcaggcagccagtgcaccgaggccacccgcggctcctcttcgtgatcacagatggcgctgtcaacaacacagggaaggtgctggagctggtgcgaaatcacgccttctccaccaggtgctatagctttggaattggacccaacgtctgccacagactggtgaaaggactggcatctgtgtccgagggcagtgctgagctcctgatggagggggagcggctgcaacccaagatggtcaaatccttgaagaaggccatggccccagtcctgagcgatgtgactgtggagtggatcttccctgagaccactgaggtcctggtctcacccgtcagcgccagctccctcttccctggagaacggctggtggggtatggcattgtatgtgatgcttctttgcacatctccaatcccagatctgacaagaggcgccggtacagcatgctgcactctcaggagtctggcagctctgtcttctaccactctcaggatgacggacccgggctggaaggtggagactgtgccaagaactcgggggcacccttcatcctagggcaggccaaaaatgcccggctagccagcggagactctaccaccaagcacgatctgaacctctctcagcgacggagggcatacagcaccaaccagatcaccaatcacaagcccctcccaagagccaccatggcaagtgaccccatgccagctgccaagagatacccactgcggaaagccaggctgcaggacctcaccaaccagaccagcctggatgtccagcggtggcagattgatttgcagcccttgctgaacagtggtcaggacctgaaccagggccccaaactccgtggcccaggggcccgaaggccctctctgctgccccaaggctgccagcccttcctgccctggggccaggagacccaggcctggagccctgtgagagagcggacttctgacagccgaagccctggagatctggagccgtcccaccatccctctgccttcgagacagagacgtcctcggactgggaccccccagccgagtcccaggagcgagccagtcccagcaggcccgccaccccggccccggtgctgggcaaggccctggtcaaaggcctgcacgacagccaacgcctgcagtgggaggtgagcttcgagctggggacccctggaccggagcggggcggcgcgcaggatgccgacctatggagcgagaccttccaccacctggcggcccgcgccatcatccgcgacttcgagcagctggcggagcgcgagggcgagatcgagcaggggtccaaccgccgctaccaagtgagcgccttgcacaccagcaaggcctgcaacatcattagcaaatacacagccttcgtgcctgtggacgtgagcaagagccggtacctgcccaccgtggtggagtaccccaactctgctgccctgcgtatgcttggctctcgggccctggcccaacagtggaggggcacctcttctggctttggaaggccgcagacgatgcttggagaagattcggcaccaggaaatggtcctagaaagtgctcacagacattgatgggttttaaaacaaaaacagaaacagaacacagtgtgagggggtggaaacccagaggagctcttcagaatcaaagtgttctctcaacttcttggtcccattggcctccaaaacccaggagaaccagctccacccctgagccaagctga

SEQ ID NO: 794 - DNA, 4490 bp, Homo sapiens
atcgcaatgtgggcattgatcaagccagctgccagggcagcgggcgcagggcttgggcactggagcccagccccggaccgcacctccagcagtgctgggtgcagaaggcagtcactgtggcagtggagagacagagtgtgtacccagacacgtgttgcttctggggtaaggttctgaaggctgagtagccagcgggatgcccggcttgctgaattggatcacgggggcagccctgcccctcaccgcgtctgatgttacctcctgtgtcagcggttatgccctgggcctaactgcctccctcacctatggcaacctggaagcccagcccttccagggcctcttcgtgtaccccctggatgagtgcaccacggtgatcggctttgaggcagtcattgccgaccgtgtcgtgacagtacagatcaaggacaaagccaagctggagagcggccacttcgatgcctcccatgttcgatccccaacagtcacagggaacattctgcaagacggggtttccatagcccctcattcctgcacaccgggaaaggtgaccttggacgaggatttggagcggatcctgttcgtggccaacctggggaccattgcccccatggagaatgtcaccatcttcatcagcacctcctcggagctcccaacgctgcccagcggggctgtgagggtccttctgcctgctgtctgtgccccaaccgtgccccagttctgcaccaagagcactggcacctccaaccaacaggcccagggcaaagacaggcactgcttcggtgcctgggccccgggctcctggaataagttgtgcctggcgactctcctgaacaccgaagtgtccaaccccatggagtatgagttcaacttccagctggagatccgtgggccatgtctgctcgcaggggtggagagtcccactcatgagattcgtgccgacgccgccccatctgcccgctcggccaagagcatcatcatcaccttggccaacaagcacacctttgaccggcctgtggagatcctcatccaccccagcgagccccatatgccccatgtcctgatagagaaaggggacatgaccctgggagagtttgaccagcacttgaagggaagaacagatttcattaaagggatgaagaagaagagcagagcagagcggaagacagaaatcattcgaaaacgcctccacaaagacattccccaccactccgtcatcatgctcaacttctgtcccgacctccagtcagtccagccgtgcctgagaaaggcccacggggagttcatcttcctcattgacaggagcagcagcatgagcgggatcagcatgcaccgagtcaaggatgccatgttggtggcccttaagagcctcatgccagcctgcctcttcaatatcattgggtttggatccacatttaagagcctttttccttccagccagacctacagtgaggacagcttggccatggcttgtgatgacatccagagaatgaaggccgacatgggtgggaccaacatcctttcccctctcaagtgggtcatcaggcagccagtgcaccgaggccacccgcggctcctcttcgtgatcacagatggcgctgtcaacaacacagggaaggtgctggagctggtgcgaaatcacgccttctccaccaggtgctatagctttggaattggacccaacgtctgccacagactggtgaaaggactggcatctgtgtccgagggcagtgctgagctcctgatggagggggagcggctgcaacccaagatggtcaaatccttgaagaaggccatggccccagtcctgagcgatgtgactgtggagtggatcttccctgagaccactgaggtcctggtctcacccgtcagcgccagctccctcttccctggagaacggctggtggggtatggcattgtatgtgatgcttctttgcacatctccaatcccagatctgacaagaggcgccggtacagcatgctgcactctcaggagtctggcagctctgtcttctaccactctcaggatgacggacccgggctggaaggtggagactgtgccaagaactcgggggcacccttcatcctagggcaggccaaaaatgcccggctagccagcggagactctaccaccaagcacgatctgaacctctctcagcgacggagggcatacagcaccaaccagatcaccaatcacaagcccctcccaagagccaccatggcaagtgaccccatgccagctgccaagagatacccactgcggaaagccaggctgcaggacctcaccaaccagaccagcctggatgtccagcggtggcagattgatttgcagcccttgctgaacagtggtcaggacctgaaccagggccccaaactccgtggcccaggggcccgaaggccctctctgctgccccaaggctgccagcccttcctgccctggggccaggagacccaggcctggagccctgtgagagagcggacttctgacagccgaagccctggagatctggagccgtcccaccatccctctgccttcgagacagagacgtcctcggactgggaccccccagccgagtcccaggagcgagccagtcccagcaggcccgccaccccggccccggtgctgggcaaggccctggtcaaaggcctgcacgacagccaacgcctgcagtgggaggtgagcttcgagctggggacccctggaccggagcggggcggcgcgcaggatgccgacctatggagcgagaccttccaccacctggcggcccgcgccatcatccgcgacttcgagcagctggcggagcgcgagggcgagatcgagcaggggtccaaccgccgctaccaagtgagcgccttgcacaccagcaaggcctgcaacatcattagcaaatacacagccttcgtgcctgtggacgtgagcaagagccggtacctgcccaccgtggtggagtaccccaactctgctgccctgcgtatgcttggctctcgggccctggcccaacagtggaggggcacctcttctggctttggaaggccgcagacgatgcttggagaagattcggcaccaggaaatggtaaatttcaggccctaaacatggaggcaagtcccactgctctcttcagcgaggccaggtcccccggccgcgagaagcacggtgcttctgaaggtccccagcgcagcctggctacaaatactctttcttccatgaaggcctcagagaatctctttggatcctggctaaatctcaacaagtccaggctactgacgcgagcagccaagggcttcctgagcaagccactgatcaaagctgtggagtcgacctccgggaaccagagcttcgactacatacctctggtgtctctgcagctggcctccggagccttcctgctcaacgaagccttctgtgaggccacgcacatccccatggagaagctcaagtggacgtcccccttcacctgccatcgagtgtccctcaccacccgcccgtctgagtccaagaccccgagtccccagctgtgcaccagctccccgcctaggcacccgtcctgtgacagcttctccctggagcctctggccaagggcaagctgggcctggagccgagggcagtggtggagcacactgggaagctgtgggccacggtggtggggctggcatggctggagcacagttcggcctcctacttcactgagtgggagttggtggctgccaaggccaactcatggctggagcagcaggaagtacccgagggccgcacgcagggcacactcaaggccgctgcccgccagctgtttgtgcttctgcggcactgggatgagaatctcgagttcaatatgctctgctataacccgaattatgtgtagttgagtgacggggaggctgggtggagggaagggtggggaggagagggatgggcagggccatgtcggcctggtttcggggagcttttggagctgtaactaatatttcagttactagaaagagccctggactggcagccaggaggcctgagttcaatcccaactttgctaccatccagccatgcaactttaggccagtgcctgcccccgtctgggcctcagtttcctcatctataaaataagagggcgagatgaaggaggtggagtggatctcaaatggttcagtggttcctttctgcccattcaggcagtcccgggctgactgctgctggggctggcgagggaagatgcagtggaagcctgagccctgtctggaggtagaccacgtgggcacggagtggacacagcaatgcccactcaaataaaagggcagatgagagaacccagtgacctcaagtaaccaggcctacaggcttgcataggcacatagagactagcaagtctggtgcctgtaggacaggctcttgtctccatggtaacagccaaggaccccccctaaatcccacttaaaagccaattggagaagcatccttctcaacgctttacaaaagagtagtttgggggccttttgttt

SEQ ID NO: 795 - DNA, 5460 bp, Homo sapiens
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtcaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccagctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 796 - DNA, 2615 bp, Homo sapiens
tgggtcctggccgccggcttcgctgagacgcgctcgcgtgggctgccctcccgggcccgcagtggtcgcggcggcatgaagggcgctctggggagtcccgtggctgccgctggcgccgcgatgcaggagagtttcggctgcgtggtggccaaccgcttccatcagctgctggacgacgagtcggacccgttcgacatcctgcgcgaggccgagcgccggcgccagcagcagctgcagcgcaagaggcgcgacgaggcggcggcggcggccggggccggtccccgcggcggcaggagcccagccggggcctcgggccacagagccggcgcgggcggccggagggagtcgcagaaggagcgcaagagcctcccggcgcccgtcgctcagcggcccgatagccccgggggcggcctgcaggcgccgggccagaagcggactcctagaagaggggagcagcaaggatggaatgacagccgtgggccggaggggatgctcgaaagagctgagcggagatcctacagggaataccgaccctatgagacagagaggcaggcagacttcacagctgagaagtttccagatgaaaaaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatagcagtcagaactgaagacaacatgggtggatgtggagttcgaacctggggatcgggtaaagataccagtgatgtggagccaactgcaccgatggaggaacccacagtggtggaggagtcccagggcaccccggaagaggagtctccagccaaagttcctgagttggaggtagaagaagaaacccaagttcaagagatgactttagatgagtggaaaaatcttcaagaacagaccagaccaaagcctgagtttaacatccggaaaccagaatccactgttccttccaaagccgtggtgattcacaagtcaaaatacagagatgatatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaactatggacccagagcagaagtggtgatgcaagatgttgcccccaacccagatgacccggaagatttccctgcgctgtcttgaaagagccctgtttcccagcaccgcggagctgcactgcacacctgtggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaagaaattaaaatacaattgcacttactgtttacttgtaaatgttatcttctctcctggaatattttgagttctggttttcacttaaccaatcatttaaaaatcgctattgtgtagccactggccaccactctgtgacacagaatcagagaaagcgttgatttttaatggtgatttaaactacctcgtggtttctgtgtgtgtgcacacacacatctagtgtttgggtggtttttaggaagaatattaagtatgtgacttcaaaaaccatgttatttaacctgccaatcaaatggaaagggatcatggcaaaagcaaataccgcatccttttcttccgcagaactagagtcagagttcggcagctgcgtacaaaggcctctgccctcggcttgagcaaaagttgtaaataactagtatttattaagcacttataagcagtttttctcacttagtcctggctccagttctagagttcctctttattgcttttggtgaaagtttggggttgggggtacacctcagaggttcagtaattcacctggagtcccaccctgaacagagctggacccagagccacacacgcccgggaacacacactgtgctggggaggaagtgggcctaggagggcctgcaggtccaggcagctgtagagctgctagaagctggggtgttgctctccccgctttctcatagacacagaggtactgtctgcctgttgtcacacagttcatatgctcgcttgagatggaatctgaaccttggtcccaggatctgtgctttttcccactttgccacactgtctaaggtggctttgaactggaacccaagtgcaaataaaggttggtattcgctcctga

SEQ ID NO: 797 - DNA, 2304 bp, Homo sapiens
ggcatgggtcctggccgccggcttcgctgagacgcgctcgcgtgggctgccctcccgggcccgcagtggtcgcggcggcatgaagggcgctctggggagtcccgtggctgccgctggcgccgcgatgcaggagagtttcggctgcgtggtggccaaccgcttccatcagctgctggacgacgagtcggacccgttcgacatcctgcgcgaggccgagcgccggcgccagcagcagctgcagcgcaagaggcgcgacgaggcggcggcggcggccggggccggtccccgcggcggcaggagcccagccggggcctcgggccacagagccggcgcgggcggccggagggagtcgcagaaggagcgcaagagcctcccggcgcccgtcgctcagcggcccgatagccccgggggcggcctgcaggcgccgggccagaagcggactcctagaagaggggagcagcaaggatggaatgacagccgtgggccggaggggatgctcgaaagagctgagcggagatcctacagggaataccgaccctatgagacagagaggcaggcagacttcacagctgagaagtttccagatgaaaaagttcctgagttggaggtagaagaagaaacccaagttcaagagatgactttagatgagtggaaaaatcttcaagaacagaccagaccaaagcctgagtttaacatccggaaaccagaatccactgttccttccaaagccgtggtgattcacaagtcaaaatacagagatgatatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaactatggacccagagcagaagtggtgatgcaagatgttgcccccaacccagatgacccggaagatttccctgcgctgtcttgaaagagccctgtttcccagcaccgcggagctgcactgcacacctgtggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaagaaattaaaatacaattgcacttactgtttacttgtaaatgttatcttctctcctggaatattttgagttctggttttcacttaaccaatcatttaaaaatcgctattgtgtagccactggccaccactctgtgacacagaatcagagaaagcgttgatttttaatggtgatttaaactacctcgtggtttctgtgtgtgtgcacacacacatctagtgtttgggtggtttttaggaagaatattaagtatgtgacttcaaaaaccatgttatttaacctgccaatcaaatggaaagggatcatggcaaaagcaaataccgcatccttttcttccgcagaactagagtcagagttcggcagctgcgtacaaaggcctctgccctcggcttgagcaaaagttgtaaataactagtatttattaagcacttataagcagtttttctcacttagtcctggctccagttctagagttcctctttattgcttttggtgaaagtttggggttgggggtacacctcagaggttcagtaattcacctggagtcccaccctgaacagagctggacccagagccacacacgcccgggaacacacactgtgctggggaggaagtgggcctaggagggcctgcaggtccaggcagctgtagagctgctagaagctggggtgttgctctccccgctttctcatagacacagaggtactgtctgcctgttgtcacacagttcatatgctcgcttgagatggaatctgaaccttggtcccaggatctgtgctttttcccactttgccacactgtctaaggtggctttgaactggaacccaagtgcaaataaaggttggtattcgctcctga

SEQ ID NO: 798 - DNA, 1678 bp, Homo sapiens
atgcctaggagaggctactccaagcctgggtcctggggcagcttctgggccatgctgaccttggtgggcctggtcacccatgcagcacagagagccgatgttggcggggaggcagctggcacctccatcaaccactcccaggcggtgctccagcgcttgcaggagctgctgcggcagggcaacgccagcgatgtggttctgcgggtgcaggctgcgggcaccgatgaggtccgggtattccacgcccaccgcctgctgctgggactgcacagtgagctgttcctggagctgctaagtaaccagagcgaggcggtgctgcaggagccacaggactgcgccgctgtcttcgacaagttcatcaggtacctgtactgcggggagctgaccgtgctgctgacccaggccatccccctgcacagactggccaccaagtacggcgtgtcctccctgcagcgcggcgtggccgactacatgcgcgcgcacctggcgggaggcgcgggcccggcggtgggctggtaccactacgcggtgggcaccggggacgaggccctgcgcgagagctgcctgcagttcctggcctggaacctgtcggccgtggcggccagcaccgagtggggcgccgtgagccccgagctgctctggcagctcctgcaacgctcggacctggtgctgcaggatgaactggagctgttccacgcgctggaggcctggctgggtcgcgcgcggccgccccctgccgtggccgagcgggcgctgcgcgccatacgctaccccatgatcccaccggcacagctgttccagctgcaggcgcgctcggcagccctggcgcgccacggccccgcggtggccgacctcctgctgcaggcctaccagttccacgccgcgtcgccgctgcactacgccaagttcttcgacgtcaacggcagcgccttcctgccccgcaactacctcgcgcccgcctggggcgccccgtgggtcatcaacaacccggcccgcgacgaccgcagcaccagcttccagacgcagctgggcccgagtggccacgacgcgggccgccgggtcacctggaacgtgctcttctcgccgcgctggctgcccgtcagcctgcggcccgtttacgcggacgccgcgggcactgctctgcccgccgcgcgcccggaggacggccgaccgcggctggtggtgacgccggccagcagcggcggcgacgcggcgggcgtgagcttccagaagacggtgctggtgggggcgcgccagcagggccgcctgctggtccgccacgcctacagcttccaccagagcagcgaggaggccggcgacttcctggcgcacgccgacctgcagcggcgcaactccgagtacctggttgagaacgccctgcacctgcacctcatcgtcaagcccgtataccacacccttatccggacccccaagtagcctcggggtctgggaataaaggcctggcctaggtggtccctgtgggtctgggaagggcaaggcgagcctggaggtggcaacaagcctggtcccctggatggccaggcgccggccaccctagggctggggtggagtccaggtgaggcgtggtagacaagatgcctggtttcaagagctgatttcacagctgacttgaaggaacgttcttggtcctgaataaaccgatgctcagagtggtaaa

SEQ ID NO: 799 - DNA, 1059 bp, Homo sapiens
atgtgctgccctggcgggcactataccctcattttaagacgaggaaacagattcagacgcgagaagagaccagccaaggtcactggggctcaaaccgaagtccagctggctcctccgctgccccgaggacgggcccggaggtctccctggagcgtgcccatttccctcagcattgaccgtctggagtttgaccttctgtatcctgccatcaagggtgacaccattcagctctacctgggggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggatgcccttgtgcttactccagcctccttgtggaaacccagctctcctgtctcccagtgaagacttggatggcagccatcagggaaggctgggtcccagctgggagtatgggtgtgagctctatagaccatccctctctgcaatcaataaacacttgcctgtgatgcctgc

SEQ ID NO: 800 - DNA, 1024 bp, Homo sapiens
tgagtgggggagagagaggagaccaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcatca

SEQ ID NO: 801 - DNA, 1063 bp, Homo sapiens
tgagtgggggagagagaggagaccaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgaactatttcttgctgctcaatccatttcctctggcccagcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcatca

SEQ ID NO: 802 - DNA, 983 bp, Homo sapiens
aatgtgagcaagccctggtggcagcgccagggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccagggctggtgggctggctaatcagcggcaggaaacaccagcagcagcaagagagcaggtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtg

SEQ ID NO: 803 - DNA, 1116 bp, Homo sapiens
ccagggttccacatgttgctctcccaatgtgagcaagccctggtggcagcgccagggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccagggctggtgggctggctaatcagcggcaggaaacaccagcagcagcaagagagcagcatcaacatcaccaacattcagctggactgtggtgggatccagatatcattccataaggagtggttctcggcaaatatctcacttgaatttgaccttgaattgagaccgtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtg

SEQ ID NO: 804 - DNA, 1822 bp, Homo sapiens
agaaggttgtgaatccatgctaaaggtaaacaaactgcaacttatatctgcaatttattttggtatagacaagaggtatgccagtagcacactggtggcttcagaagaaattctcaacacctagctcgccagagagtctatgtatgggattgaacaatctgtaaactaaaggatcctaatcatgaaaataagtatgataaattataagtcactattggcactgttgtttatattagcctcctggatcatttttacagttttccagaactccacaaaggtttggtctgctctaaacttatccatctccctccattactggaacaactccacaaagtccttattccctaaaacaccactgatatcattaaagccactaacagagactgaactcagaataaaggaaatcatagagaaactagatcagcagatcccacccagacctttcacccacgtgaacaccaccaccagcgccacacatagcacagccaccatcctcaaccctcgagatacgtactgcaggggagaccagctgcacatcctgctggaggtgagggaccacttgggacgcaggaagcaatatggcggggatttcctgagggccaggatgtcttccccagcgctgatggcaggtgcttcaggaaaggtgactgacttcaacaacggcacctacctggtcagcttcactctgttctgggagggccaggtctctctgtctctgctgctcatccaccccagtgaaggggtgtcagctctctggagtgcaaggaaccaaggctatgacagggtgatcttcactggccagtttgtcaatggcacttcccaagtccactctgaatgtggcctgatcctaaacacaaatgctgaattgtgccagtacctggacaacagagaccaagaaggcttctactgtgtgaggcctcaacacatgccctgtgctgcactcactcacatgtattctaagaacaagaaagtttcttatcttagcaaacaagaaaagagcctctttgaaaggtcaaatgtgggtgtagagattatggaaaaattcaatacaattagtgtctccaaatgcaacaaagaaacagttgcaatgaaagagaaatgcaagtttggaatgacatccacaatccccagtgggcatgtctggagaaacacatggaatcctgtctcctgtagtttggctacagtcaaaatgaaggaatgcctgagaggaaaactcatatacctaatgggagattccacgatccgccagtggatggaatacttcaaagccagtatcaacacactgaagtcagtggatctgcatgaatctggaaaattgcaacaccagcttgctgtggatttggataggaacatcaacatccagtggcaaaaatattgttatcccttgataggatcaatgacctattcagtcaaagagatggagtacctcacccgggccattgacagaactggaggagaaaaaaatactgtcattgttatttccctgggccagcatttcagaccctttcccattgatgtttttatccgaagggccctcaatgtccacaaagccattcagcatcttcttctgagaagcccagacactatggttatcatcaaaacagaaaacatcagggagatgtacaatgatgcagaaagatttagtgactttcatggttacattcaatatctcatcataaaggacattttccaggatctcagtgtgagtatcattgatgcctgggatataacaattgcatatggcacaaataatgtacacccacctcaacatgtagtcggaaatcagattaatatattattaaactatatttgttaaataaca

SEQ ID NO: 805 - DNA, 2159 bp, Homo sapiens
atgtggatggcctggtgtgtggctgcgctgtctgtggtggctgtgtgtggcaccagccacgagacaaacacggtcctcagggtgacgaaagatgtgttgagcaatgccatttcaggcatgctgcagcaaagtgatgctctccactcggccctgagagaggtgcccttgggtgttggtgatattccctacaatgacttccatgtccgaggaccccccccagtatataccaacggcaaaaaacttgatggtatttaccagtatggtcacattgagaccaacgacaacactgctcagctggggggcaaataccgatatggtgagatccttgagtccgagggaagcatcagggacctccgaaacagtggctatcgcagtgccgagaatgcatatggaggccacaggggcctcgggcgatacagggcagcacctgtgggcaggcttcaccggcgagagctgcagcctggagaaatcccacctggagttgccactggggcggtgggcccaggtggtttgctgggcactggaggcatgctggcagctgatggcatcctcgcaggccaaggtggcctgctcggcggaggtggtctccttggtgatggaggacttcttggaggagggggtgtcctgggcgtgctcggcgagggtggcatcctcagcactgtgcaaggcatcacggggctgcgtatcgtggagctgaccctccctcgggtgtccgtgcggctcctgcccggcgtgggtgtctacctgagcttgtacacccgtgtggccatcaacgggaagagtcttattggcttcctggacatcgcagtagaagtgaacatcacagccaaggtccggctgaccatggaccgcacgggttatcctcggctggtcattgagcgatgtgacaccctcctagggggcatcaaagtcaagctgctgcgagggcttctccccaatctcgtggacaatttagtgaaccgagtcctggccgacgtcctccctgacttgctctgccccatcgtggatgtggtgctgggtcttgtcaatgaccagctgggcctcgtggattctctgattcctctggggatattgggaagtgtccagtacaccttctccagcctcccgcttgtgaccggggaattcctggagctggacctcaacacgctggttggggaggctggaggaggactcatcgactacccattggggtggccagctgtgtctcccaagccgatgccagagctgcctcccatgggtgacaacaccaagtcccagctggccatgtctgccaacttcctgggctcagtgctgactctactgcagaagcagcatgctctagacctggatatcaccaatggcatgtttgaagagcttcctccacttaccacagccacactgggagccctgatccccaaggtgttccagcagtaccccgagtcctgcccacttatcatcaggatccaggtgctgaacccaccatctgtgatgctgcagaaggacaaagcgctggtgaaggtgttggccactgccgaggtcatggtctcccagcccaaagacctggagactaccatctgcctcattgacgtggacacagaattcttggcctcattttccacagaaggagataagctcatgattgatgccaagctggagaagaccagcctcaacctcagaacctcaaacgtgggcaactttgatattggcctcatggaggtgctggtggagaagatttttgacctggcattcatgcccgcaatgaacgctgtgctgggttctggcgtccctctccccaaaatcctcaacatcgactttagcaatgcagacattgacgtgttggaggaccttttggtgctgagcgcatgagtgacagaggcagagatgctgctgcaactggaagaagctggaaccagtcccagagaggctcggcctggaaacagtcccctgcccagagtcccctcagcctccatgacaggtccctccctggccccccaaccctcttcctcccttgccccaaccctgagaaagggtccagccactaccctgttggcaaacattcccttccatggtcagcctgccaggaggaggggagtcaccttggggctggaggcctctcagaccccatcctgacagcaggttgagtattcccactttcaataaaagactccactttcccggca

SEQ ID NO: 806 - DNA, 1454 bp, Homo sapiens
atgcagccagtcatgctggccctgtggtccctgcttctgctctggggcctggcgactccatgccaggagctgctagagacggtgggcacgctcgctcggattgacaaggatgaactcggcaaagccatccagaactcactggttggggagcccattctgcagaatgtgctgggatcggtcacagctgtgaaccggggcctcttgggctcaggagggctgcttggaggaggcggcttgctgggccacggaggggtttttggcgttgtcgaggagctctctggtctgaagattgaggagctcacgctgccaaaggtgttgctgaagctgctgccgggatttggggtgcagctgagcctgcacaccaaagtgggcatgcattgctctggcccccttggtggccttctgcagctggctgcggaggtgaacgtgacatcgcgggtggcgctggccgtgagctcaaggggcacacccatccttatcctcaagcgctgcagcacgctcctgggccacatcagcctgttctcagggctgctgcccacaccactctttggggtcgtggaacagatgctcttcaaggtgcttccgggactgctgtgccccgtggtggacagtgtgctgggtgtggtgaatgagctcctgggggctgtgctgggcctggtgtcccttggggctcttgggtccgtggaattctctctggccacattgcctctcatctccaaccagtacatagaactggacatcaaccctatcgtgaagagtgtagctggtgatatcattgacttccccaagtcccgtgccccagccaaggtgccccccaagaaggaccacacatcccaggtgatggtgccactgtacctcttcaacaccacgtttggactcctgcagaccaacggcgccctcgacatggacatcacccctgagctggttcccagcgatgtcccactgacaactacagacctggcagctttgctccctgaggccctggggaagctgcccctgcaccagcaactcctactgttcctgcgggtgagggaagctcccacggtcacactccacaacaagaaggccttggtctccctcccagccaacatccatgtgctgttctatgtccctaaggggacccctgaatccctctttgagctgaactccgtcatgactgtgcgtgcccagctggctccctcggctaccaagctgcacatctccctgtccctggaacggctcagtgtcaaggtggcctcctcctttacccatgcctttgacggatcgcgtttagaagaatggctcagccatgtggtcggggcagtgtatgcaccaaagcttaacgtggccctggatgttggaattcccctgcctaaggttcttaatatcaatttttccaattcagttctggagatcgtagagaatgctgttgtgctgaccgtggcatcctgaggctgagacatggccaccagcct

SEQ ID NO: 807 - DNA, 815 bp, Homo sapiens
tcttgagctaggaaaggattactcgcgcctcgttagaatcagacatggcttcaggggatgcaggacgctcccctgagctgcctgtcaccgactaagtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagcccagacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacacaaggaatgaactattggcaaggctggaagaaacattgtgagggcagagacctgtccgagtggaaaaaaggctgtgaggtttcctaaactggaactggacccaggatgctttgcagcaacgccctaggatttgcagtgaatgtccaaatgcctgtgtcatcttgtcccgtttcctcccaatattccttctcaaacttggagagggaaaattaagctatacttttaagaaaataaatatttccatttaaatgtcttcaccc

SEQ ID NO: 808 - DNA, 2449 bp, Homo sapiens
gaccaagaacacaagcatcttaatttgaatccacaaagtttcatgtaatgaaaagaaatacataattttaattcaacccgagtgttttccaagaagattgtatttgcttaaattgctacagtaattcaagagacagccctgtctggacacagagttactgtggatttttaagagactcagttaaagaatttaggaatttctgattcatttaaaggatttacaaattcatcaacccctgaaaactaaagcaaattgaacaggaaaaaaaaaaagaagatgggttttttaagtccaatatatgttattttcttcttttttggagtcaaagtacattgccaatatgaaacttatcagtgggatgaagactatgaccaagagccagatgatgattaccaaacaggattcccatttcgtcaaaatgtagactacggagttccttttcatcagtatactttaggctgtgtcagtgaatgcttctgtccaactaactttccatcatcaatgtactgtgataatcgcaaactcaagactatcccaaatattccgatgcacattcagcaactctaccttcagttcaatgaaattgaggctgtgactgcaaattcattcatcaatgcaactcatcttaaagaaattaacctcagccacaacaaaattaaatctcaaaagattgattatggtgtgtttgctaagcttccaaatctactacaacttcatctagagcataataatttagaagaatttccatttcctcttcctaaatctctggaaagactccttcttggttacaatgaaatctccaaactgcagacaaatgctatggatgggctagtaaacttgaccatgcttgatctctgttataattatcttcatgattctctgctaaaagacaaaatctttgccaaaatggaaaaactaatgcagctcaacctctgcagtaacagattagaatcaatgcctcctggtttgccttcttcacttatgtatctgtctttagaaaataattcaatttcttctatacccgaaaaatacttcgacaaacttccaaaacttcatactctaagaatgtcacacaacaaactacaagacatcccatataatatttttaatcttcccaacattgtagaactcagtgttggacacaacaaattgaagcaagcattctatattccaagaaatttggaacacctatacctacaaaataatgaaatagaaaagatgaatcttacagtgatgtgtccttctattgacccactacattaccaccatttaacatacattcgtgtggaccaaaataaactaaaagaaccaataagctcatacatcttcttctgcttccctcatatacacactatttattatggtgaacaacgaagcactaatggtcaaacaatacaactaaagacacaagttttcaggagatttccagatgatgatgatgaaagtgaagatcacgatgatcctgacaatgctcatgagagcccagaacaagaaggagcagaagggcactttgaccttcattattatgaaaatcaagaatagcaagaaactatataggtatacacttacgacttcacaaaacctatacttaatatagtaaatctaagtaaacatgtattactcaaagtaatatatttagaattatgtattagtataagatcagaattgaatttaagttgttggtgacatctgcatcatttcataggattagaacttactcaaaataatgtaaatctttaaaaatataaattagaatgacaagtgggaatcataaattaaacgttaatggtttcttatgctctttttaaatatagaaatatcatgttaaagaaagtgagtgtatcatttctattaacagtaatttttctaaaaatgaggaaggaagtagcattagcagtaaagacccacaggccatgacctttttgatcactctgaggacaatatttaaatgacaggaaggtatattaatgtaacaagcattcatttaaggaatagaccattttctctgacctcttcttcaggaaagctttcacactggtatttgtgatctcaccattatgacatccatccccctagctcaccacatagcacatagaatgatatttttgatttgtaagaggccatccaggtactaaggacccaaggcatacagattcacaaaattaactaatctttttgcctcagaataccaaaacaacaaaattataaagctgtatttggacaactaaaaaacaccaaactatctcattgcaatttgtattttagcagatttcagcaactatcctaaacaatgttattgtgttccattttaactgggataaatgtttttgtaaaaatacaaccatagaaaggcctctttgttacaaaatgatttgcaaagaaataactgctttgtttgcaagattaaattagtgttggcaaaataaagttctaaagataatactaaaca

SEQ ID NO: 809 - DNA, 506 bp, Homo sapiens
gtgacccgtccagtcacacagggtctcaaactccaaggagccccacacctggtttaatgctctgctgttgccctcttgctgatgcccttcttatttttttagagacagggtcttgcttccagcctgggcaacagagtgagactctatctcaaaaacaaaacaaaacaaacaacaaaaaatgggctggaggagcgggttgtaggcccttccgcctctggtgggtggggagaagcaggggagctggtgttcagctatattctacaaagaaggggtggatcctgagaggcaagggtgggactgaggcctagttacaggtggtcgggaaggaggttgaaggggaactgtgtgaccttggatgttctttgtaattatcttatgcttagctgacacatctgtaaaatggagatagcagcacccacttctttgagttgtgagaagtaaatgcatgtgaaatgtttagcgtgtgccgggcaccaagttaagagcccagtaaatgttggctgtta

SEQ ID NO: 810 - DNA, 2942 bp, Homo sapiens
ctcactcacctccgcactgcagccaagggaggcccgccctggcgtgggctgctgcctgtggctttgggcaggcaggagcgaaagggccaggggttgcctgtcctcccccaccctgttgaggccttcctccccctctgctgagcctcggttaattataactctgacctaagtgccctgtgacgtcaagcccgggccagccctgcccaggagacccagcaaccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgaccccgacctgcactttgatgctgagcgactgggtcagggacgcgcgcgcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccgattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctagcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcgagacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaagtgacagggttgggttccagagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtccacccctagacccttctccctggagctgattggccaggacgcagcggggcggcgcctgcacagggctgcccctcagcctagcactgtagtccctgtccttctggagcttagtggcccctcgggtttcttggccccgggcagcaaagtcccgctcagtctccgcatcgccagcttctcgggccctcaggatcttgaccttaggactttcgtcaaccccagcttctccctcacctccaacctctccagggctcacctggaactgaatgagtcggcctggggccgcctgtggctggaggtcccagattcagcggccccggattccgtggtgatggtgactgtgactgcagggggacgagaagccaacccagtacccccgactcatgctttcctccggctcctggtatcggccccagccccgcaggtgaggaaccactactttccatcacagggaccggcacaccacccctaccggctcatctgacccgatcctcaccacggccacccctgccttttcccccttcacattggtgactcaaggcagggctggggcagggctggctgcgggcagcccctggtggggcacagttggaggggtgctgcttctgctaggcctggcctcctggtga

SEQ ID NO: 811 - DNA, 2881 bp, Homo sapiens
cctggcgtgggctgctgcctgtggctttgggcaggcaggagcgaaagggccaggggttgcctgtcctcccccaccctgttgaggccttcctccccctctgctgagcctcggttaattataactctgacctaagtgccctgtgacgtcaagcccgggccagccctgcccaggagacccagcaaccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgaccccgacctgcactttgatgctgagcgactgggtcagggacgcgcgcgcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccgattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctagcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcgagacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaagtgacagggttgggttccagagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtccacccctagacccttctccctggagctgattggccaggacgcagcggggcggcgcctgcacagggctgcccctcagcctagcactgtagtccctgtccttctggagcttagtggcccctcgggtttcttggccccgggcagcaaagtcccgctcagtctccgcatcgccagcttctcgggccctcaggatcttgaccttaggactttcgtcaaccccagcttctccctcacctccaacctctccagggctcacctggaactgaatgagtcggcctggggccgcctgtggctggaggtcccagattcagcggccccggattccgtggtgatggtgactgtgactgcagggggacgagaagccaacccagtacccccgactcatgctttcctccggctcctggtatcggccccagccccgcaggaccggcacaccacccctaccggctcatctgacccgatcctcaccacggccacccctgccttttcccccttcacattggtgactcaaggcagggctggggcagggctggctgcgggcagcccctggtggggcacagttggaggggtgctgcttctgctaggcctggcctcctggtgacaca

SEQ ID NO: 812 - DNA, 4837 bp, Homo sapiens
agagcgcggagagggaccaggcaggcgccggaggggacccgcgcggaaaaggaagaagcccaaacaaaaacgctgtccggcgccaggcgcccacctgcaagcccaagccggtgctcggccagttacaaaagaaatggtcaggatctggacaacgataatgatagtattaatcctcctattaagaatcggcccaaacaaaccctcgctgtcagggcgacaggcgcccgcccaagcccagacctcggacctggttccaagcctgttcccgctgggtctctgggcgcccggtttctgcacctggagctcgcccgatgaggacaagaggccgaggaagccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggagagccgctgcaggaacagggaggaggccttttccaccgcacccggagcgtttacaacgggctggagctgaatacctggatgaaagtggagaggctgttcgtggagaagttccatcagtcgttttccttggacaattaacaagttaggcttccacagtgccagggcctggggatgctggacgtgggagagggttgtggtcgttagcctgggaaaatcattcttttaaacaatattcgccggaaaattagttttttcctaacatttctcaaacaaggcaattagggccgtcagaatcggtgctggaagacgaagtccccacagtgcaataatgaggttcccacggaaaatcagtacgttgtgttcgtaactgagataacagctagagaaggggctttgggctttttgagtctcccaatagtcagtctctctctctctctctctctctctcttcctctgactttctggctttggacactcccaatggtatatttctttgtggtgtttttatatttggatataagagaggaacttcttgttggatttttaagggaacacacttcgttttgacccttccaataaggaaaggggagctacaggaacagagagctctttagaaggttacttttaaatggaggcccccccattcatggtacccactcccacttggacctctgagacctccagaattaggcatcattctaaaatctggacattagaagtcacagactttgtatataaccacatattcataatttatcttttcaatgttttttattcatagatgaaaatcttgcaggcatagttaagaaaaatataattcctagaaagtacaagggaaggattatgctctgcagatacatgactaacaaggatagctggccatgcccagggctggtgttggttgaggaggtggtgatggtgcggggcatgtgtgtgtgtgtgtgtgtgtgcgcttgaggagttgtggaagtgttcatatctgtaaagtattatttcatggatgcagaccttaatgctaggttgaataactttgttgccatagaagaagaaccgcacgtcaggcttttttcattagcaaaccagtaagcactcactttgggcctctgaaatcacttccatcacctaacaccagagatacaaactgaagctagcccttaagagcctccccctaagatttagagagaatgatttctcaaccagttttcatctttgaaagtgccatttctccctttatcattgtgatttttattcaaatgcatgagtctctgattttctaccatatacaaagggtagagactacagtttcctatagaagaaacttcacatagtggccgaaggatcttatttctcaaaattcaggaactggtttcctctttctggaaattatgacattaacttgatttcatggtatctctttcatcttcctcaatgcctgtgctgtatgtatatttttattatatactgtaggtatatttttattaccaaaaaaaggagaatttgagcatgccacaatcttgaaaaatctgaggttgccctgctgtagaaccctttaactgccaggactttgtactgtttcccaagtgttaccagagccaggccgccagccttatgcagtctgtttaccttagctggaaccagggtgctgtgctgtgggttctatgaaactttctgtttcttcatatttggctttgtaattcctttcttatcagttttggaggcatttcctattattcctctgccatatgttttctgccaaattaattgccttaagattttccttaagcttttggaaatgtataatgtttgagaaaaaagaaaaagaatagactgagtggaatcgtatctagtttcagttaataacatgtttcagttgatgttactgttatagctactgggcataaagtctccttcccttttttgaatcctatttttgaggcattgaagctgtgtctgtaagagacaataggccagttgggttaaatcagtgacgagattgtccagtgcagattggtgcccagtgagtggatcttcactgctcacaggccggactggggtcagctcacacagcgaggtgacggtccgctcctcaagcagtggatggtgctcttcggccttgcagatgccgctccattttcctggcttcaaaattttccagatatttcagtgcccccagaatgacatgctaacattctgctggcatgggagcatgaggcagtttgtctctaaaacatgccagagaatctcttgtcactacctaggcaaagaaccagtggcaaggtggcagcctcccaaagagctcatccctaatgtgacatcctggaatcagatggcacggacaccggcccagccccttcccagctctgtgactaaggacaagtgacaccccccctcccccagcctcggtctcctcctgtgtacattcagaaggcagatgctgccatgaggccatgtgtgctatgtccatggtgcaaggtggcacgcatgccgagtcaccaggtgagactgccgctttgggaagggataggaaggatctccggtagccttcgtgggcaggatgcctcttatttgaatgtgcctttagccacctcacagagcctatttccacatccctgtggattcatccctgtggaaatcttgagaatcatttatcctatgctgtcatgaagcagcagcagaatggagaaggtttaaaaagactcatggacaggcaaagcggtcaaacacctcctggctcagacgcacttgccttcccacacacaagtctggaagctcaggatggtgttcacggaggcagatgctcggggccggggcctgagtttcctggggcacagcctccatatctggggttccctggactatgcccagatagctcataatgtcccagccttatttgtgatggagaaggacttggggaaaagccaccgggaagcagtaagtctaaccagggaagtgcactgacttgcatgctttgaagaagagaagggagaaaagatacaaaaccctcacctggtttgtctgtaacagttgttatttctcaggggagctgcattaatgggccaagcctgtgcagctgggtgtgtgaagcatgcattttgcaatggactgtctccaaaagcagagcgaggtcacccaagaaatctagagcaagggaaaatactcattagcaaaggaattttgctggagccttgtaacggccgactcattatttcctttccaagttattttaaatgaaattttaaaaaacatcttgctttccaagaaattttgcttgttggcatatgtttggtgttttgattcagtttggaggatgaactagttaatttccctgggagtacatgcctattaaaaatatagcatcctgcatctgaccaagatgctatcttactatcttattgtgcctatcttttatgcggagagagaaaggggggtgttgggaaggagaccagactgtggaaacattttctttattttttctctttttcttccttttatagtttgtttatttttcaacttgacatgggtagagaaagcgaatcgctagtatagaaagcacatctggaatccatccggcctcctctctctggctcaccctcctcccagcaatgtttctccttggaagttgggggaaggtaggcacctctgaccttggcagggtctaacttggggtcatccactgcatactcatcttccagaaggcgtcttattcctcctcgacaaaaaaaaaatgtgttggtattaaaatgctttgaggtaggctggatgaacccagcttagtgaggatgacatgaaaacccttagctaatggggtctttattgagtagaactcaggtaagttcagatgtaagcagtgtctctcagtaaacatgaaaagactgaagatgcagacaatcaaatacttaagtctcttgaagagctgggtggtgggcgggggtcttcccaggtggtcagggagatgtgttagtgtagcacttggaagagagtggaacgaccaggcaaggatgtgccgtggaggtgggcagtgggagcagcccagtgtcagcatctgtattggttagaagaccaccgctaatgaggaggagcgtctctaccctgcagctgtctgtactcctgtgtcttccgtaatgtgccaagctctctgaatatatgcaaaactagtctgcaaaaagccatatgtctcagcatctggctttatttctaagtgttcaggtggaatttaagccgcgatcaaatttacaatgtcactgccagctctggacacttacttttggaataaagcaaagagtgaacact

SEQ ID NO: 813 - DNA, 726 bp, Homo sapiens
atgcgttttatggcaggccctgcagggagccagagtctgggtcccctgtgcttccacagcagcccccaagccctctacacggtcctcttaatagtgctggtcatgatgagcttggtgtttggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtt

SEQ ID NO: 814 - DNA, 720 bp, Homo sapiens
atgcagaccttcccagttgctggggcgctggaccctgctatactggacacaagcagcccccaagccctctacacggtcctcttaatagtgctggtcatgatgagcttggtgtttggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtt

SEQ ID NO: 815 - DNA, 2654 bp, Homo sapiens
accaggacagatttgtgctcagtggattgggtggtgtttttagtatggagcagaacagaattcctaggactgcgtgtgatgaaatgcaaggtcaaaaggaaaagacaaagcatatttcaaagatgagaaatatttgtttggatatctatgactgtctgtttatactgtaaggggcttaatcagcagctccatcttttagttttagttctaaaggaaaagtagcctaaagtcagtataactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 816 - DNA, 1025 bp, Homo sapiens
cttacagaactcccacggacacaccatgattaggaccctgctgctgtccactttggtggctggagccctcagttgtggggtctccacttacgcgcctgatatgtctaggatgcttggaggtgaagaagcgaggcccaacagctggccctggcaggtctccctgcagtacagctccaatggccagtggtaccacacctgcggagggtccctgatagccaacagctgggtcctgacggctgcccactgcatcagacaaattataaaggcccacaaggttctgcaacgttgttcacttatcctcttctttgtccgtgacctctgctcatcacagctggaactcaccggagtttctgccggctcctccgggatctaccgcgtgatgctgggccagcataacctctacgttgcagagtccggctcgctggccgtcagtgtctctaagattgtggtgcacaaggactggaactccgaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccagttgctggttgtggactatgccacctgctccagctctggctggtggggcagcaccgtgaagacgaatatgatctgtgctgggggtgatggcgtgatatgcacctgcaacggagactccggtgggccgctgaactgtcaggcatctgacggccggtgggaggtgcatggcatcggcagcctcacgtcggtccttggttgcaactactactacaagccctccatcttcacgcgggtctccaactacaacgactggatcaattcggtgattgcaaataactaaccaaaagaagtccctgggactgtttcagacttggaaaggtcacagaaggaaaataatattatataaagtgacaactatgcaaatc

SEQ ID NO: 817 - DNA, 923 bp, Homo sapiens
cttacagaactcccacggacacaccatgattaggaccctgctgctgtccactttggtggctggagccctcagttgtggggtctccacttacgcgcctgatatgtctaggatgcttggaggtgaagaagcgaggcccaacagctggccctggcaggtctccctgcagtacagctccaatggccagtggtaccacacctgcggagggtccctgatagccaacagctgggtcctgacggctgcccactgcatcagctcctccgggatctaccgcgtgatgctgggccagcataacctctacgttgcagagtccggctcgctggccgtcagtgtctctaagattgtggtgcacaaggactggaactccgaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccagttgctggttgtggactatgccacctgctccagctctggctggtggggcagcaccgtgaagacgaatatgatctgtgctgggggtgatggcgtgatatgcacctgcaacggagactccggtgggccgctgaactgtcaggcatctgacggccggtgggaggtgcatggcatcggcagcctcacgtcggtccttggttgcaactactactacaagccctccatcttcacgcgggtctccaactacaacgactggatcaattcggtgattgcaaataactaaccaaaagaagtccctgggactgtttcagacttggaaaggtcacagaaggaaaataatattatataaagtgacaactatgcaaatcaca

SEQ ID NO: 818 - DNA, 1184 bp, Homo sapiens
cacagctagttttccctctaacgacttcttcaagatcaggggctatgtcttattcgtttttttatgtccccggggattagctagttcttgggaaacaactgggacttgggattcaaaacagtttgctaagtgaatgaatgagaggcccagtcaagctacttcccttcagtgctgcacagtgcaacaaataaccagctcagatacaggttcaaagaccacaggcttctccctggacagctcagctctcctcataactcctgagaaaccctggacatgccagggtgtactatggagtggttgcatccggaagagggggaggaagtcccaaacactaagtaatccaggtttgggttggaaaacaaggttgaagttactcattagcaggtgaaagggtcaagggtcgaacgcaagggagctgaaagcagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 819 - DNA, 922 bp, Homo sapiens
ccccaaacctgccaccgacggccacttccgtttccccgatagtatttggggatctcgaagcgatacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaaggtaaggggttaaaatctcataaaacaggattaggactcaccaagtcttctggtgttacagggtgaaagaggctcgtgtgatgtcaccagagggatgtggctaagagctgtgatgtcacctgagggaggcaggatgggttctgggctactcaaaagagaggtttctgagtttgcactggataaagggggcagagggtcatacgtggagggaaaagagccttagagactcccctttgacacagggaatgaaagaacacgttctcccccaccccattactatcaactttgcttttctccctggacttcccttctgtccttctttttccctccccccatcacagaggcctgtgagctgtccaa

SEQ ID NO: 820 - DNA, 709 bp, Homo sapiens
cccaaacctgccaccgacggccacttccgtttccccgatagtatttggggatctcgaagcgatacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 821 - DNA, 1030 bp, Homo sapiens
gcttacagaactcccacggacacaccatgataaggacgctgctgctgtccactttggtggctggagccctcagttgtggggaccccacttacccaccttatgtgactagggtggttggcggtgaagaagcgaggcccaacagctggccctggcaggtctccctgcagtacagctccaatggcaagtggtaccacacctgcggagggtccctgatagccaacagctgggtcctgacggctgcccactgcatcagtcaatcaatggttcagtgtgcccacaaggttctgcaacgttgttcacttatcctcttctttgtccgtgacctctgctcatcacagctggaactcaccggagtttctgccggctcctccaggacctaccgcgtggggctgggccggcacaacctctacgttgcggagtccggctcgctggcagtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaaccaaaagaagtccctgggactgtttcagacttggaaaggtcacagaaggaaaataatataataaagtgacaactatgcaaatc

SEQ ID NO: 822 - DNA, 467 bp, Homo sapiens
ccttgttggctgtcctctccctgctgacctaaatgacaaagggaggggtgtccagtcagagtgtgagggctgtacccgtgggcagctgagggagtgcgagccacaggccaggcactctccttctcccattagctcagccgtggcatcggacttgcagcttcattttgggctgccttagccatgaagctccttttgctgactttgactgtgctgctgctcttatcccagctgactccaggtggcacccaaagatgctggaatctttatggcaaatgccgttacagatgctccaagaaggaaagagtctatgtttactgcataaataataaaatgtgctgcgtgaagcccaagtaccagccaaaagaaaggtggtggccattttaactgctttgaagcctgaagccatgaaaatgcagatgaagctcccagtggattcccacactctatcaataaacacctctggctga

SEQ ID NO: 823 - DNA, 389 bp, Homo sapiens
gctctgccatgctcctcaaggcaataaataccagtctggactgcccagaatggagtcctctgtctgttttaccagttgagaagcctcctatccctccctgatcattcatcattcatgaagctccttcttctgcttttgactgttactctgctcctggcccaggtcaccccagtcatgaaatgttggggcaagtcaggcaggtgcagaacaacatgtaaagaaagtgaagtatactatatattatgcaaaactgaggctaagtgctgtgtggatcccaagtatgtacctgtaaaaccaaaattaacagacacaaatacaagcctggaatcaacttctgcagtctgacacctctcttccaaccttgagtctcaacatcatgggatcctgca

SEQ ID NO: 824 - DNA, 324 bp, Homo sapiens
atgaaacttctttacctgtttcttgccatccttctggccatagaagaaccagtgatatcagtagagtgttggatggatggacactgccggttgttgtgcaaagatggtgaagacagcatcatacgctgccgaaatcgtaaacggtgctgtgttcctagtcgttatttaacaatccaaccagtaacaattcatggaatccttggctggaccactcctcagatgtccacaacagctccaaaaatgaagacaaatataactaatagatagaaatgactttgtttcaggttgcttagggtccacatttcattaaaactcacaaatttg

SEQ ID NO: 825 - DNA, 457 bp, Homo sapiens
gttctaattcactgcccacagccctgctgataaaagcaaagctcatctctgccgtgctgcagggaaccctatttccttcccctgcagctcagccacctcctcctctcaggtctgccagccatgaaacttctttacctgtttcttgccatccttctggccatagaagaaccagtgatatcaggcaaacgccacatccttcgatgcatgggtaacagtggaatttgtagggcctcttgcaaaaagaacgaacagccctacctctattgcagaaattgtcagtcctgctgcctccagtcctacatgaggataagcatttctggcaaagaggaaaataccgactggtcttatgagaagcagtggccaagactaccttgagtgctggtgattaccattctcaagctctctgggcacagagacctgctgtcaacccccctcattaaaattcatgtgcctgcta

SEQ ID NO: 826 - DNA, 3832 bp, Homo sapiens
ggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 827 - DNA, 3894 bp, Homo sapiens
ggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcca

SEQ ID NO: 828 - DNA, 3783 bp, Homo sapiens
agaagtaggaggggcgtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 829 - DNA, 3820 bp, Homo sapiens
gtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 830 - DNA, 3949 bp, Homo sapiens
gtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 831 - DNA, 2238 bp, Homo sapiens
cttgtggagcattcgggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcagatgccatctacgactgctcttccctctaccagaagaactaccgcatctctggagtgtataagcttcctcctgatgacttcctgggcagccctgaactggaggtgttctgtgacatggagacttcaggcggaggctggaccatcatccagagacgaaaaagtggccttgtctccttctaccgggactggaagcagtacaagcagggctttggcagcatccgtggggacttctggctggggaacgaacacatccaccggctctccagacagccaacccggctgcgtgtagagatggaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaagaaccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtga

SEQ ID NO: 832 - DNA, 4978 bp, Homo sapiens
agctgagctccctgggtgatggctccttccacaagttctaacgtcccactgaaagcaagctgcaatttctgttgcttcttgtatcaattgcatgaaaggacgggcagtttcttttgatcctctggcatgccaaggcctgaatgccagtcctgggagccttaccagccctctaagaagaatcagaagcctgaccgggcgggaagtcctgacgcccttcccaggattgggcactgcggcagccccggcacagggcggggcccacctgaagccacattctcttgtcctgcccatcacagcgctgccaccaccgcctctggccctcagagggcggcaggcaacctctaagcttcctcctttcctctcttccccctttcctccctccctatgcccctgggtgcccgatccaggcttcaaagagacagctttcctgtacgcggtgtcctctgccgccctcacccacaccctggcccgggcctgcagcgctgggcgcatggagcgctgcacctgtgatgactctccggggctggagagccggcaggcctggcagtggggcgtgtgcggtgacaacctcaagtacagcaccaagtttctgagcaacttcctggggtccaagagaggaaacaaggacctgcgggcacgggcagacgcccacaatacccacgtgggcatcaaggctgtgaagagtggcctcaggaccacgtgtaagtgccatggcgtatcaggctcctgtgccgtgcgcacctgctggaagcagctctccccgttccgtgagacgggccaggtgctgaaactgcgctatgactcggctgtcaaggtgtccagtgccaccaatgaggccttgggccgcctagagctgtgggcccctgccaggcagggcagcctcaccaaaggcctggccccaaggtctggggacctggtgtacatggaggactcacccagcttctgccggcccagcaagtactcacctggcacagcaggtagggtgtgctcccgggaggccagctgcagcagcctgtgctgcgggcggggctatgacacccagagccgcctggtggccttctcctgccactgccaggtgcagtggtgctgctacgtggagtgccagcaatgtgtgcaggaggagcttgtgtacacctgcaagcactaggcctactgcccagcaagccagtctggcactgccaggacctcctgtggcacccttcaagctgcccagccggccctctgggcagactgtcatcacatgcatgcataaaccggcatgtgtgccaatgcacacgagtgtgccactcaccaccattccttggccagccttttgcctccctcgatactcaacaaagagaagcaaagcctcctcccttaacccaagcatccccaaccttgttgaggacttggagaggagggcagagtgagaaagacatggagggaaataagggagaccaagagcacagcaggactgaaattttggacgggagagaggggctattccatcttgcttcctgggatgaatggcttggagccagcatgttcttgggaggtgaactgctgggctaggaatgccaaggcaggcagtgccagctggaagtgaaggcgggagcctggctgagatgggtcaatcgggtcctgtggccctgctcaggtgcagtgggctccaggtgtcacacacctccaccactcccctggttttgctgtgccagagatggggagaaagcacaggtggtagaagccatccgttcagagaaaggagagctttctgtgcttgagtggacccgagtgagatctgtgccctggagccctgtgtccttgatttggcttttcaaatatgcctccgctgaggcctcattcttgtctcgagagctgggttatgcacactcacccagccgtgctcaaaactaccaccagtgcaggtaagacaggtgggagaactagccaccaaggcgggactcagtgcacctgaggttgaacagggagacaacggcccctccctgtgttccctgctggccaaaggaatcttcactcccagcgcagaggaggagggcaacagcttcctggtgcctggcagtgacgtggcgagctcagtttctcagctggctcttgagtgagctttggtgacttcctgtggctggggcctgcctggtctgtgacacccccataccagctgagttcacaatactgaagaacagctggctcacgagctatgacttgaagttacatttctattcttgtggctgctcatctagttaaggcttttgccctggctggggttataggtgcttgagtccttgctaagcctggctcctgggtagcctccttcagttcctaatggcctctcacttggccctcactttggctcttacttgaggaggagacgtgactttgataatttcctcagatcctgtggacattttcagcagcacctgccaaggccctctgtgaaaggaggagagactggtacctccacacaggcacacatggatgcacagcccctggaccaggctgggggttcctgttgcacatgcctctcttgttcaggatgaagaccttgcaggggtccccttgctggaggcattgtacttccccagagtggggcccgatgccacccaggaggaagtgacttctttcgggaagcccttggccactttgctggccctgccacgcccatctgtcagcttcctttctccctaaacctagagttgctgacccttcaccaacacaggaaatttcagaatcagctgaatgctcagaaacctcgcctgtgccagctccaggacaaaggcccgctgactgtgccctggccaactccctgagacctccaagggcgaggaggagctgcccagtctccagtggatcagggcagtctgctggatgctggaaggatttttgactgcagaggcccggctgagaagccaaactgacctgagcccctctcgttaaaatgacattgctgacccaagcacctggcccacaccttggcagcaggagaaaaatggggagagggctggttttctcctttcttccacttccccacagcatggagattttctctgccttcccaatccatcttgctcctccgagaccccaactctgcctccacccaggctcagtgctgggcgtaaggcagcagggacctcactggcagagcagggggcctgggagcaacgtggaggccagagcaccctgatccaccaacatgccacctgcattctgacttcatggctggcagtgccagggtcgtgggagggcaaagggcaggctctaaggcatctaggcagtggctggctgctaacatggacaccccaagtcaatggcacagtgcaggttctgagggctccttggcttgtggggtcttctctgtctgtctctctccctctcttcttccttgctctcatccctttcttttccagttacccctgaagacccacctcggccctcttggggcccctggggactagagtgaccactgacccctcattctacagctttaagggaaatgctcacagggtatttttgtctacctcaaatatatagtttttagagcaaaggagaataatttatatagctaagatatatgagaaagtatttatattatttatatagttgctatatttcacagacagcacaggtggggtttgtgtattttcccggaaaccctctgtctggggagatacagcctgacctgaccgggtcccccactgagcaggaggccgggtcgctgggaaggaggacaaacctgtattccatgactgggtctgtctcggagctggtaagcacatgtccgctctgtgatgagccctggtgggctccatccagaccctccttgtgatgtttttgtagattttctgcccttctgggtccaggcccccttcttctgctctggcaaaagtgtcttactcataatgataatgacaacgagaattcccacacctggcatttgtaaagcactttgctatttagaaacaaaaacttttacccctttcatctcacttgatttctccgttatctctgtgaggtaggtggggccacattactgtggccattttatagatgaggtccagagatggagagctgtgctcaaagtcacacctaagagacttgttcaatgaatatttactgaacatctccatagaccaggcactacgggctgacctgctctgagcccaggagccccaaagcctggataccactgtgagcccaagaactcagggaagcagttccttcccaggctgtgatcccagccttttggatctggatggcatgttggcacttcccccaagtggagtcccatgtctcaggggctttggctgcctgagaaggctggagagaccaggaacccatggaggccactccaaggggtccttctgcccacactgcccaagaagcttgggctacaccactgggcccctcccaacctacagatgaattttgattgctctcatttgtgttttgcttgtaaaaatgaattgttttccactggatttctggctgcttttgcaaaagtcagctgcgctggcagactgggcctgcatgtcctcctgcaggcagctagagtgagggagtctaatggacaggatgccccaagtgcccccgttgctcatggatgcccctgcctgcctctcatgagcacatagtcctgtcccctggtctagataagcccagctttcctggtacccttcatcacctggcagacagacagccccatgccaaccctggacattacttgcttttgaacctttcctttctcaacaaccatgaacttcaaatgctttctgtctcaggacactttagaataacaatggaagccatcacttattgagcaccccttatgtccatttattcaaccaatgattatttagggatctcttattgagcaccaggcagcatcctgggtgcttggtgcagcaaggaacaggaccaagtctctgcctcatggggctgacatcctagtgggtgagaaagacaataaaccaataaatgacatgcc

SEQ ID NO: 833 - DNA, 485 bp, Homo sapiens
tctcacaatgaaacatcttcgtccccagttccctctcatcttggccatctactgcttctgcatgctacagattccctcctcaggatttcctcaacctttagctgatccttcagatggcttggatattgtgcagcttgagcagctggcatattgtctgagtcagtgggcacctctttctcgccaacctaaggataatcaagacatatacaaaaggtttttgtttcactactccagaactcaggaggcaacacatccagttaaaactgggtttcctccagtgcatcctctaatgcacctggctgccaagctcgccaacaggcggatgaagagaattctgcagcgaggctcggggactgctgcagtggacttcaccaagaaggatcacactgcgacctggggacgaccctttttccttttcaggcccaggaatggaagaaacattgaagatgaggcccagattcagtggtgaaagaaagctggatctg

SEQ ID NO: 834 - DNA, 2033 bp, Homo sapiens
ttcctcccggcgtgctccgcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggcacatcatcctggggggggccgtgttgctcacagccctgcgtcctgctgcgccagggcccgcgccaccgccacaggaggcctgatggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccgggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgc

SEQ ID NO: 835 - DNA, 825 bp, Homo sapiens
tgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccgttgctgtgtgccaccctccctgtaa

SEQ ID NO: 836 - DNA, 1592 bp, Homo sapiens
ggagcctgcatcatgtcgagtccgcagaggaggaaggctatgccctgggcactgtcactgcttctcatgggcttccagctcctggtgacttatgcctggtgttctgaagaggaaatgggtggtaataataaaatagtccaggatcctatgttcctcgccacagtggagtttgccttgaacactttcaacgtgcagagcaaggaggagcatgcctacaggctgttgcgcgtcctgagttcatggagggaggatagcatggacagaaagtggcgaggtaagatggtgttctccatgaatctgcaactgcgccaaaccgtatgtaggaaatttgaagatgacattgacaactgcccttttcaagaaagcctggagctgaacaacgtaagacagggcatcagctttcctcaggtccacagctgtggatgctgcatggggtgtggtgtgggcacaggagcagctgacaaagccattccgagggacaaagggaagtgagcccacagcaggctgtaccaggctgccctgcttgtgccttagtgggaagcccagtgaggcattaagcccaggggttcactttcaggcccctggccaatctgagtttcctgattctgccctctgacaccattgcagctgcctgcacctgggccacatggccttcagaaccttctctctggtcttcctccccacttcttccctgccttctagagaaagagcctggagacaatggtgacaatgtctgtgggtacttttctcagggtttccctaccctgccctagacccaaaagtggtggaggctgagaagaagccccactgccctcgctcctaggccctgctgagctgcagcacctgctctaggggacgagctccaagcaaagcctggctctgggaaaacttcccattcttagtcaacccccttattgtaagattaacaaataggtaactaattgcctaagtctgggaactgcttccactgggacaaaacattctcctgctgctcttggatgcagggatcacaccaggacagcctggggttcccctgaggggcacgggctggaggaggaggcatggcacaagtgaccctggctaaggagggagggagcctcaaatcacgttgtagttcaggattggcctcaggctcaggctagacctgaaggccagagccacgtggcacaattgctggccccaggaatgggcaaggtggagatggaacctgtgttgagggcagatgccacaagattcccgaacctccccaaaccccgccctactgtctcttcctgtttgttccctcggaccttcagctgcttcttcactgttgaaaccatgccctggaagacatattttgaactcctgaacaagacctgctcagaggggctctcctgagtggaagccactcacatgcctggccacatgctgccccctcccccgtggacaccagctgttcccaggagttgacatatcagtggctgagcagctccgtgcatatttgttctcttattttgcaagtgtctgaggttttatgacttggcattttagaaaatcctcactgtccaggttcctcaagtagaataggtcattaaacatcagcatttgcagaa

SEQ ID NO: 837 - DNA, 4385 bp, Homo sapiens
ccctctcttccccccgccctgccttcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggc

SEQ ID NO: 838 - DNA, 959 bp, Homo sapiens
agccttcaaagctagtggcagagggtagctcccctcctgcctgtggcttgtgctggcctagagagtatagggcagaaggatggcagatgagtgactccacatccagagctgcctccctttaatccaggatcctgtccttcctgtcctgtaggagtgcctgttgccagtgtggggtgagacaagtttgtcccacagggctgtctgagcagataagattaagggctgggtctgtgctcaattaactcctgtgggcacgggggctgggaagagcaaagtcagcggtgcctacagtcagcaccatgctgggcctgccgtggaagggaggtctgtcctgggcgctgctgctgcttctcttaggctcccagatcctgctgatctatgcctggcatttccacgagcaaagggactgtgatgaacacaatgtcatggctcgttacctccctgccacagtggagtttgctgtccacacattcaaccaacagagcaaggactactatgcctacagactggggcacatcttgaattcctggaaggagcaggtggagtccaagactgtattctcaatggagctactgctggggagaactaggtgtgggaaatttgaagacgacattgacaactgccatttccaagaaagcacagagctgaacaatactttcacctgcttcttcaccatcagcaccaggccctggatgactcagttcagcctcctgaacaagacctgcttggagggattccactgagtgaaacccactcacaggcttgtccatgtgctgctcccacattccgtggacatcagcactactctcctgaggactcttcagtggctgagcagctttggacttgtttgttatcctattttgcatgtgtttgagatctcagatcagtgttttagaaaatccacacatcttgagcctaatcatgtagtgtagatcattaaacatcagcattttaagaaa

SEQ ID NO: 839 - DNA, 444 bp, Homo sapiens
atgtggagtctgccgccgagcagggctctgtcctgtgcgccactgctgcttctcttcagcttccagttcctggttacctatgcttggcgtttccaagaggaagaggagtggaatgaccaaaaacaaattgctgtttatctccctcccaccctggagtttgccgtgtacacattcaacaagcagagcaaggactggtatgcctacaagctggtgcctgtcctggcttcctggaaggagcagggttatgataagatgacattctccatgaatctgcaactgggcagaaccatgtgtgggaaatttgaagatgacattgacaactgcccttttcaagagagcccagagctgaacaatacctgcacctgcttcttcaccattggaatagagccctggaggacacggtttgacctctggaacaagacgtgctcaggcgggcattcctga

SEQ ID NO: 840 - DNA, 4104 bp, Homo sapiens
acatctccctcctgctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtga

SEQ ID NO: 841 - DNA, 4299 bp, Homo sapiens
gcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 842 - DNA, 4527 bp, Homo sapiens
ccctctcttccccccgccctgccttcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtg

SEQ ID NO: 843 - DNA, 1312 bp, Homo sapiens
cagcgccccgcaccggggccgttagtcagcagaacgcgagctcttgtggaggagcagggccggcgcgaggcgagactcgggagcgtgagcggggcccctggggcgccgccgtccttcttcgccccggcgccgggggctgtagccctggtccccgctcctctgtcgggccagtctgcaggcggagagagtcggacggcgcccggagcgcggatctcgccttgtggaggacagcgcgtcggctgcggttctctctcgaccccttctgcccggcgcttcggcccgggccgctcaggtgcagagcatgaataatctttcatttagtgagctatgttgcctcttctgctgtccaccttgtccagggaagattgcttcaaaattagcgtttttgccacctgatccaacttacacactgatgtgtgatgaaagcggaagccgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttctcacatggaaatgctgttgatcttggtcaaatgagcagcttttacataggactaggatcacggattaattgtaatatattctcatatgattattctggatatggtgccagttccgggaaacccacagagaagaacctctatgcagacattgaagctgcttggcttgctcttaggacaagatatggcattcgccctgaaaatgtgattatatatggccaaagtatagggacagtaccgtctgtggatcttgctgctcgatatgagagtgctgctgttattcttcattctcctctgacttcgggaatgcgagttgcctttcctgataccaagaagacctactgttttgatgcattcccaaacattgacaaaatctctaagataacctctccagtattaataattcatgggactgaagatgaagtcattgacttttcacatggcctcgcattgtttgaacgttgccaaagacctgtggagcctctctgggttgaaggagcaggtcacaatgatgtggaactttatggacagtatcttgaaaggttgaaacagtttgtgtcacaggaactggtgcagaaacataaagaagggaagtgattttctcaaggtctacagttttcaatgacggtactatgtattccattatcttctctttaccaaacttaactggattaatataccaatgatcctttcaaattatatgacataaacttatttgctctccaa

SEQ ID NO: 844 - DNA, 1959 bp, Homo sapiens
agctccggccccgaccggaagccccaccgcaccgtcagggacgcggactcgggagtgcgcacattcgcagcccgggcagccctgctgcgcaccgggcctcgcgccccgcgccccgcgccccgcgccccgcgccccgcaccggcctccaggatcatgtggtatgtcagcaccaggggcgtagccccacgggtcaactttgagggggccctcttctctggctatgcacctgacgggggcctctttatgcctgaagagctcccacagttggacagagggaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggaccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtg

SEQ ID NO: 845 - DNA, 5162 bp, Homo sapiens
gtctcctggaccccctttcgtgacccctctcaacacctctactggggagacgaggaccccgaggttctggggggcgacgcgacctgcccgaagtgacaagggtcctgggccgcactgctccgccggggtctgcgctcctcggcggagcgggtgggaaggatgagtcctcggggtggagaaggaggagcgggtccccgggtaccgctcacccggccttaggagcccgggagcgcgcgtagggacgcggagttgaggctctccatctgcggccagggaaagggatacagtcccccgggcccctcccggccgctcggaacccaccccaggcgcgtccccgcgggcgcgcgctccaggcggggccgacgggctcggaggcgcgcgcccgctgccgggtccgccgcgcgcgctccctccgctcctctcccccgcccctcccgggcccgcgcgctcccagggtccgccgcgcgcgcgcctcgcgtcgctccccatccccgcccctcccgccgccaccccgcccccggccgggtaccctcgccggacccgagagagagcgccgccgccatcttagttgctgccgctgccttcagcaagacgctgctctgaggcggggagggcgccgcgtcctgagcgcgcggcccagcgtcacggcggcggcggcggcggctcctccttggacccccggagctccccgcgccgcggagcagctagccccaggcccctagagccccgagagctccgagagctccgctcggcgtcccgcgcgcctccctgccgctcccgccccgggctggcgatgctgcgccgccccgctcccgcgctggccccggccgcccggctgctgctggccgggctgctgtgcggcggcggggtctgggccgcgcgagttaacaagcacaagccctggctggagcccacctaccacggcatagtcacagagaacgacaacaccgtgctcctcgaccccccactgatcgcgctggataaagatgcgcctctgcgatttgcagagagttttgaggtgacagtcaccaaagaaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaact

SEQ ID NO: 846 - DNA, 5221 bp, Homo sapiens
gtctcctggaccccctttcgtgacccctctcaacacctctactggggagacgaggaccccgaggttctggggggcgacgcgacctgcccgaagtgacaagggtcctgggccgcactgctccgccggggtctgcgctcctcggcggagcgggtgggaaggatgagtcctcggggtggagaaggaggagcgggtccccgggtaccgctcacccggccttaggagcccgggagcgcgcgtagggacgcggagttgaggctctccatctgcggccagggaaagggatacagtcccccgggcccctcccggccgctcggaacccaccccaggcgcgtccccgcgggcgcgcgctccaggcggggccgacgggctcggaggcgcgcgcccgctgccgggtccgccgcgcgcgctccctccgctcctctcccccgcccctcccgggcccgcgcgctcccagggtccgccgcgcgcgcgcctcgcgtcgctccccatccccgcccctcccgccgccaccccgcccccggccgggtaccctcgccggacccgagagagagcgccgccgccatcttagttgctgccgctgccttcagcaagacgctgctctgaggcggggagggcgccgcgtcctgagcgcgcggcccagcgtcacggcggcggcggcggcggctcctccttggacccccggagctccccgcgccgcggagcagctagccccaggcccctagagccccgagagctccgagagctccgctcggcgtcccgcgcgcctccctgccgctcccgccccgggctggcgatgctgcgccgccccgctcccgcgctggccccggccgcccggctgctgctggccgggctgctgtgcggcggcggggtctgggccgcgcgagttaacaagcacaagccctggctggagcccacctaccacggcatagtcacagagaacgacaacaccgtgctcctcgaccccccactgatcgcgctggataaagatgcgcctctgcgatttgcagagagttttgaggtgacagtcaccaaagaaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaa

SEQ ID NO: 847 - DNA, 1197 bp, Homo sapiens
aagaaagacagtcagcaaagcctgggagagctccagctcctccctccctgctctgctcaacttcactctcctcctcggttcccttggagtaccttgtgccccggcagtgctgtcccggccctggcatcctgaggtcctcccgtggtgaggacttaagtggacagcaggagtgggtggagagagggagggagagtttgccctgcaggctctctggatgcagaagccagactcgctgcagaggcagctgtgctgttcccggagcctggcttcaggggtgcatccgtcactcagggttcattcacccaggcaggctccaagttcctggggtgcacaaggtgggcactgtcccttctgggtgctgacagcagagcctggctcccctccgccaccatgagcggctgctccaaaagatgcaagcttgggttcgtgaaatttgcccagaccatctttaagctcatcactgggaccctcagcaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaaga

SEQ ID NO: 848 - DNA, 1601 bp, Homo sapiens
tccacagattgtcattcttcagggatggcagccctaaacacagcatggcaactcatctactcactcatgaaagattaaaaaatggaaaccaacgtatttcatcttatgctctgcgtcacttctgctcggactcataaatccacgtctctttgctttggccacttcaactcatatccaagccttcctttaattcatgatttattgctgatgatgtcaggtcataggatgatatatataatcagtgagcaggcagaatgaggagacagttgaaagttctctacaacagaagccaagaaggaagccgtctatcttgtggcgatcatgtataagctggcctcctgctgtttgcttttcataggattcttaaatcctctcttatctcttcctctccttgactccagggaaatatcctttcaactctcagcacctcatgaagacgcgcgcttaactccggaggagctagaaagagcttcccttctacagatactgccagagatgctgggtgcagaaagaggggatattctcaggaaagcagactcaagtaccaacatttttaacccaagaggaaatttgagaaagtttcaggatttctctggacaagatcctaacattttactgagtcatcttttggccagaatctggaaaccatacaagaaacagagaagaaagctgaggcaagatttaagattgtggaagaaagagcctggcttacgaatttttaaaaactatgtgtgggtgtgaatttcatctatcattccaagtttaagaaggaatcagggacttctctaaaaagcaccagagagtgagctgatttatcaagtaaacaatcacactcacttcttaaaagacacaactacaaacgccatagaaagcggtgactgatggagcctgcaggaccctgtgggcgaggacaactgggctcgcctggacgttttctcttttgcagtccccacaacactgccctgttcaagggcaaacaaaaggcagtgccagtcagacctgtggtagggctggagcgacctcttttgtataaattgattggaaagaaagagttaactgttttggtaagaatgaaaatttaaacacagaagtatgtaagaatgatactagcttttacattacttgtaaaacattttacaatcattattttaaaaacaaaaatactcaaaagggcaacagcactgggtaagaagctctttcattttaatattacacatgcaaatgctaactgaaacttacaagaataggcccatggtaagcggatcgatttttaagataagactttcagaatttcactggaaggtgggaaatcaataggaaagggatctacaaggatgaaggccaaaactcaacccccaaaacctggttatcccagatatgctaatggacagtatgtgctaatgtgttgtgagaaaaccggaatgtttcatcttaattatggaggggaacgccaggttgaatgaagcctgtatgaacgtactacattcatggaaaccattatgaaaagtacacaacctgtaggtggcatttcttcaagcactctaaggggaaaatgacttatgtaacagaacaaaataaatgaggctaaggtttggggctca

SEQ ID NO: 849 - DNA, 3158 bp, Homo sapiens
ataacgggaggagagcgccaggcggagctggggcgtccctcccgctcgcttcttgactcgcgttgctgccggccgcctcccgcgcctagtgtccgggacgcgcctgaacctgccgcctccgtgcctggggtggcgccgcgcggccccgagcgctccagaaagctgcggcgcgagtccgcggggccgacctcggagacgcagctggggccgggcgcggcttggcgggagggtctgcagcgccgagggaggctgctggtgcgtgaggaagagagctagagactggacaggggaggcagagcagcgtcagagccgcgcaggggacgggagtgagagcaggagcgacgcagagcggccgtctcaaggtgctgctgcttctccccactcagacttggagccccgtgggagcaggaaatccacctgactgtgatgccccactggcctctgccttgcctaggtcatccttcagcagctcctcagagctgtccagcagccacggcccggggttttcaaggcttaatcgaagagatggagctggtggctggactccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatggagttggctcatgggttgcaggaccaaaacctgaaaatatctctgactgtgtgtcaccagaccacacaatgaatacatcacttaggttagcatgagaaaaagggaaaaacagctgtgaagcccatgaactttccaagaaggtaaaggagaaaaaaaaaaaaaaagatgggtttgaagtctaagttttactatgaacagcaccctgctgagatcataaaaatgaaaaataccatcaagatacatgaaaaaggaaacaccaaagggaagagtgataacaaggctccacagagtgcagtttcctttgacaagatgaaaaagaaatgaaaagaggaaggagataaatggaacagccctctacctaaagtttctgtccatggagaaactgacatttaagtgctgctcaacaggaaaaagaaaaaagacctggttattgaagttggctttgttggagatgcgttactcagatacagatacaaagatgggtttggccaatgggcatccgtgtcaagaagcctgacctaacacgttctgaatattaagctaccttttatctgccagtccttggtgttcagaagaatccctcctcctcaccctaacttctatggggctatttacaaagacactgtcattgaagtgaggaagagtgagttgggccttatgacacaaagagacaagactatttgaggacaacagacacaggttttcatatacattccatgttattctgaattactgatgggttcactgatggaattattgagtatagccaataaggagaaccacaattaagctggtatctctgggttctggatatcatcctcaagaaaactatttactaattacattgaatgaggttattaaaatgtgtaagtttcacacaaaaacaaaaagacaattcattccaaattgtgcatatggatatataatgttaattatgggaattccattttaagaattactacaattctatgtgttctgtataaaaacaggaaaatagttgttccaatatataaaaggaaaacatttaaaaatgtattttgttgggaaaatcagttgccagaattcattcagtcaactaacaagcactcctctgtggcaagaagccctgcctctctgttgtagcaggcagctacccacctaaatgatgaggtcaagaaatatacagctgataaaaagataaaaaatatgtaatagtccagtgattacatgtgtactatggatcagtgccaattacttgtaagcttttggtatttagtttgttacagcaaatgttttcttttttaaattttcttctgcaaatgttttcttgtcatgaaaactgtttcccatttggcagaattacaaaaacagtcaagaagaaatgttctgattgatgtatacagttagaatgtgtattaaagattattataaaatgataactgaattatatccatttctaaagtatgttgggacagaattttttaaaaatgtgattctgttttgaaaattgttttaccactggatcagtgtggttcttaaacttggctttatcttggagtcaccagaggagattcaaaagataccattacctggctctacctccagagatcgggattttaattggtctgtatctggattttaagagcccttctggtgattcgactgtttagctaggtttgagagccactaccctagattatctgtcctgctccagtaacattctttttctaaaatcatttatagtatattagaaataaatccatggaaattccaagt

SEQ ID NO: 850 - DNA, 1667 bp, Homo sapiens
gcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaact

SEQ ID NO: 851 - DNA, 3921 bp, Homo sapiens
gctggtgcgtgaggaagagagctagagactggacaggggaggcagagcagcgtcagagccgcgcaggggacgggagtgagagcaggagcgacgcagagcggccgtcgccgtgcccgggtctcagggcgcctggctgaagtgagcatggcttcagtggcctgggccgtcctcaaggtgctgctgcttctccccactcagacttggagccccgtgggagcaggaaatccacctgactgtgatgccccactggcctctgccttgcctaggtcatccttcagcagctcctcagagctgtccagcagccacggcccggggttttcaaggcttaatcgaagagatggagctggtggctggactccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccggaatgaatggactagtgacacaatagtcctttcccaaaaggagcacctgccagtcactcagattgtgatgacagacgcaggccgaccacattccgaagcagcttatacactggggccactgctctgccgcggagatcagtcattctggaattcagcttccttcaacactgagacttcataccttcatttccctgctttccacggagaactcactgctgacgtgtgcttcttttttaagaccacagtttcctccggggtgtttatggagaacctggggatcacagatttcatcaggattgagctgcgtgctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattgagatttccgcatattttgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagctgtggtcatggtagaggttaaccagagcacaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcttcggccgcgctgctcccctgaaggcggcgctgcgccccagcggcccctcccgggtcaccgtccgcggccacgtggcccctatggcccgctgcgcagcgggggcggcgtccggctccccggcgcgggaactggctccccgactcgcggggggcgcaggtcgttctggaccagcggatgagggagagcccttggttaatgcagacagaagagactctgctgtcatcggaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagcgagtcttctgattggcagctgtggctgtctctatcatcgtgactgtggacttccctgctgttgccatcagggtgcacacaagcaggtgcagtgc

SEQ ID NO: 852 - DNA, 2649 bp, Homo sapiens
agaaagctgcggcgcgagtccgcggggccgacctcggagacgcagctggggccgggcgcggcttggcgggagggtctgcagcgccgagggaggctgctggtgcgtgaggaagagagctagagactggacaggggaggcagagcagcgtcagagccgcgcaggggacgggagtgagagcaggagcgacgcagagcggccgtcgccgtgcccgggtctcagggcgcctggctgaagtgagcatggcttcagtggcctgggccgtcctcaaggtgctgctgcttctccccactcagacttggagccccgtgggagcaggaaatccacctgactgtgatgccccactggcctctgccttgcctaggtcatccttcagcagctcctcagagctgtccagcagccacggcccggggttttcaaggcttaatcgaagagatggagctggtggctggactccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccggaatgaatggtgatttccacatgatttccctgcacaaaaatgtggtttttattctttaattatgcatagttaattaaatgtcagacaagctggtacaataaggtaactaaagtatgttcaagcaagctgaaatacaagttttgatgaaatatgatcagttaatctaaggattaaattttatgacc

SEQ ID NO: 853 - DNA, 2513 bp, Homo sapiens
ctctttggccaagccctgcctctgtacagcctcgagtggacagccagaggctgcagctggagcccagagcccaagatggagccccagctggggcctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaagaaataagatctgacaactggctggcttcccaccttggactgcctcccgattccttgctttcttatcctgcaaattactcagatgattccaaaatctggcgccctgtggagatctttagactggtcagcaaatatcaaaacgagatctcagacaggagaatctgtgcctctgcatcagccccaaagacctgcagcattgagcgtgtcctgcggaaaacagagaggttccagaaatggctgcaggccaagcgcctcacgccggacctggtgcaggactgtcaccagggccagagagaactaaagttcctgtgtatgctgagataacaccagtgaaaaagcctggcatggagcccagcactgagaacttccagaaagtgttagccttctcccaactgtgttataccaaccacattttcaaatagtaatcattaaagaggcttctgcatcaaaccttcacatgcagctcccatgccaccctccagaattcaccaacacacaggcccaccagcaacaggctacctttgcacaatattctctgatgacaactccaaagccccggctctttccaccacactgtggtcccctagatggggctgttgctgagcccaccccaatccagatgtgatccccctgtgatctacttctggcaagattctcagtctggacaggtcttccctatgagatagaacctgataaggagctagggcaattctgacaacattaccaaaggcccacataacttctaaattttggtctggtctgaaggaaaacctgttcttgccctagtgatggatgaactctcttatctctggcttctagagggaaaaaaaagcatacctcttttactttttaagtacctccatcagagtcatgaaatcacctgtcaagactatctatcttttatgtttccattctggtaagaactctttaaatgaggacactgctgattgctggtgatgttttttgagcaaacactcgggggtatggatgaaagccaatcgcaggtcaaatgactccttggggaagctacttctcctctattcagatttcactaaaatcttccaagatgaaagcaaatctagatttcggtcttcattgctgtccatttttgtaatgaacgagtgtttttcctttagctagtgtatcaggcagggttctaccagagaaacagaaccagtaggagatacatatacatgtccagatttatttcaaagaattgatttacatgattgtggggattggcaagtccaaaatccatatggtaggcctgcaatctgtaaacctttgggcaggagctgatgctgtagtttgcagatagaattccttgttccttaaaaaaatctgtttttgttcttaagggctttgaatgattggatcaggcccacccagattacctagataatctcttttacttaaagtaaactgattgtaggtgctaatcacatctatgaaatgccttcacagcaacacctagattagcattcaattgaataactggggaatacagcctagccaagttgacacataaaattaaccatcacagcaacatgcctgctaaattttatcgaccgtcttcagactgttaaggattgtggtagagaactgtgacagccactctcagcatcaccctgaaccaaaggcccctatcaagtaacaatatagccaagcaaaattccagtcaatagagacattgactggttggctggcttcccaagggatagcaccagacaagaaatgcaaggatgaggaaaccaggcacgggagagagaggggcaacagaggtccagggtttggttatctttttatttttcactgggaggtggtaagttagccctgttgcccatgtatgcagatgggagaagtgatttagaaactccaaagcaattggtaatccccaaaatgggtgtatctggtttgaaatgaaaccttattttattggaaatggttggtttcccaattctgtttgccattggccaatataattgtgggtttgcacatggccagcacatgccaaacagaagtagacaaaggtctcactctgtaagtgggaccttggggaggagctgcctccatcataaagggaggggttagtaaaaatggtctcttaagcctgttcctgctacagttatagaggttgctcagaaccttctcagcaaatatagcagttatctattgttgtgtattaaaccatttcaacacatagtggcttaaaa

SEQ ID NO: 854 - DNA, 1947 bp, Homo sapiens
ctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccggcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccacccagaatgagccctgcagtcgacacctaccaatgcttagagacgcgtggtcggtgctgggggcgcggcctggagctgctgcctgtcccaccccaccagaagaggctgatcccgataggtatctgaccacattttttttttttttttttttttgagacggagtcaatgtcacccaggctggagtgcagtggcacgatctcggctcactgcaacctccgcccctgggttccagcaattctcctgcctcagcttcccgagtagccgggatcacaagtgcgcgccaccaagcccagctaacttttgtgtttttagttgagacagggttcaccatgttggctagactggtctcgaactccagacccaggtgatccgcccgcctcggcctcccaaagggctgggattacaggcgtgaaccacctcgccctgccgcggccacattttttcttttttttgagatggagtcttgctcttgtcacccaggcaggagtgcagtggcgcaatcttggctcactgcaacctctgcctcctgggttcaagctgttctccttactcagcctcccatgtagctgggattacaggcgtccgcaaccacgcccggctgatattagtagttttagtagaggcgggtttcaccatgtggccaggctgatctcgaactcctgacctcaggcagttcacccgtctcagcctcccaaagtgctgggattagaggcgtgagccactgcgcccggccaaccacattttcaaaacaggtcatgtggtgtcaggttggagtgtacttccagggataaccgtgggacattcttgaaatctgaactatcctgggaagtcttgaagtaatggatgcctatagtggacactcaggactcctgtccttggagcgagattggaggggcatctagcacttaacatatgccacaatgctttctgtggccattatttaacctctggttaaacaagcttaggaggctgacttactagtagtaaaaggagtgtgctttgagtcacagatcctggttgaactccagcatgttacaaacctcagccctgttctatgaaaggtcataactacgaggattattgtaaaacattaatttagaaatgtaaagtggtccccaatctctggatctggtcaggatttattggagctgccactgaggggattaaataagtggggtcaaagccccacagcctagtcaaccaagttgctcctcttttgtctatcctgtggttcccaagcaagactgcaattgaaaaaaaggctgctgttattaaagtcagaacaccaaataaagctttttttttttttttgag

SEQ ID NO: 855 - DNA, 812 bp, Homo sapiens
cgcagccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtga

SEQ ID NO: 856 - DNA, 1890 bp, Homo sapiens
agccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggaaaggaggtggctgatagatggtacagtgaaatcaagaactataacttccagcagcctggcttcacctcggggactggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaataacctc

SEQ ID NO: 857 - DNA, 1447 bp, Homo sapiens
cagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacaccatggacagctcccgggaaccgactctggggcgcttggacgccgctggcttctggcaggtctggcagcgctttgatgcggatgaaaaaggttacatagaagagaaggaactcgatgctttctttctccacatgttgatgaaactgggtactgatgacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaaggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagcccagcatcagcggggtggaccttgataagttccgcgagattctcctgcgtcactgcgacgtgaacaaggatggaaaaattcagaagtctgagctggctttgtgtcttgggctgaaaatcaacccataatcccagactgctttgccttttgctcttactatgtttctgtgatcttgctggtagaattgtatctgtgcattgatgttgggaacacagtgggcaaactcacaaatggtgtgctattcttgggcaagaacagggacgctagggccttccttccaccggcgtgatctatccctgtctcactgaaagcccctgtgtagtgtctgtgttgttttcccttgaccctgggctttcctatcctcccaaagactcagctcccctgttagatggctctgcctgtccttccccagtcaccagggtgggggggacaggggcagctgagtgcattcattttgtgcttttcttgtgggctttctgcttagtctgaaaggtgtgtggcattcatggcaatcctgtaacttcaacatagatttttttgtgtgtgtggaaataaatctgcaattggaaacaaaaa

SEQ ID NO: 858 - DNA, 1738 bp, Homo sapiens
tgcgccggcagcgctcccactttcctgtccggtgcggccccgggtccctgtattttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataacgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggtaaaaatgccatctttatttcattaagtactggttctaagtgacttccaataagatacattttcttcctgttttgaagttgatccccattgtgaaaaatatacattgtagtggtcatggaaatgcgccatccatactccctaaggcaggcttgttgccctagtatcaagcatgccagcagctttcaatggtcagcttctagaaggattgcctcggctatggtggccttgctcaaagccatgcctcctgaaggggcccaaatccagtgactgttggaggtgagaatagaaaggcctggccacttcagcacgtgagtggtgggcaactctgctgggcccaccacaactccctatggggtttagggacactgtctttggatctgcattgcaactcaacttatacctctgctcagtcctgtttcctttctcaggtgttgatcgaagggtgtgccttcatagaccccctgctaaactgcacctcagtgtttcttggagaaccaaatctgtaacatatatgcattaaaaattaaaggcagtacta

SEQ ID NO: 859 - DNA, 1829 bp, Homo sapiens
actagagtagaagtgattgaatgtgaagtgtcaggagattgctcgctcgtccttcgttaaacccctggtccggctgtgtgctgtggatgcgggtgtgtgttgaggggacctgcgtctgccggggccgcaccccctcccgcaggaccttggctggccgcgcgtttcctgcctgtttcctgtccagcagctggcgagctggggaccggcaggaaaggatgcgctgcccagaaggggcgggaaccgaccacgcccggtcccgtgtgccccccgccctcccggcgcccgccctccccacgccgtcgggggcgggccccgcggggctgtgggagccgaacgccgcggggtcagggcgtgcagtctgggacgcgggatgcttggcgctctacctcgccgcccctgagccttcccgtccgcctcgccacgcgcccggacggcctggggttgctgcccgtcagtctcgaaaggtgtttttggggaaaaaaatcacaatctggacgtgagaaaggacatgaggagactaaagacctgggattttgtcaatcagaatgaaaccaatgttgaaagacttttcaaatctattgttggtggtactctgtgactatgttcttggagaagctgaatatcttctcttgagagagccaggccatgtagcactaagcaacgacacagtgtatgtggatttccagtattttgatggtgctaatgggacactgaggaatgtatctgtcctgctgttggaggccaacaccaatcagactgtaactaccaagtacctcctgaccaaccagtcccagggaacactaaagtttgagtgcttctatttcaaggaggctggtgactactggttcacaatgactccagaagcaacagacaacagcactccattcccctggtgggagaaaagtgcctttctgaaggtggaatggcctgtctttcacgttgacttgaataggagtgccaaggcagcagaaggcaccttccaagtgggcctatttaccagtcaaccactgtgcccgtttcctgtggacaagcccaacatcgtagtggatgtcatcttcaccaacagtcttcctgaggcaagaagaaattcaagacagccgctggaaataagaaccagcaaaaggacagaacttgctcaaggtcagtgggttgagtttggctgtgcacccttggggccagaagcctatgtcaccgtggtgctgaagctgcttgggcgagactcagtcattacctccacaggacccattgacctggcccagaaatttggatacaaactggtgatggtgccagaactcacatgtgagtccggggtagaggtgacagtgctgcctccaccatgcaccttcgtccaaggagtggtcactgtcttcaaggaggcccccagataccctgggaagaggaccattcacttggctgaaaacagcctgcccctgggagagaggaggacaatttttaactgtactttgtttgacatggggaagaataagtactgctttgactttggcatttcaagcagaagccatttttctgcaaaggaggagtgcatgctaattcagagaaatacagaaacttggggactgtggcagccatggagccagtgtagtgccacatgtggggatggtgtcagagagcgtcgccgagtgtgtctcacttccttcccctccagtcctgtctgccctggaatgtccttggaggcctccctgtgttccctggaggagtgtgctggtaggtttcgctcttgttgcccaggctggagtgcaatggtgcgatctcggctcacgaactccgcctcccgggttcaagcgattctcctgcctcagcctctggca

SEQ ID NO: 860 - DNA, 546 bp, Homo sapiens
ccctggggaagagaagctgagaggaactcctcactcagctagcttcaggagccatgacatcatctctaccatggaaattccactcactctcctgtgcccccacatttgtcctaggcctcagagtccctataaagagagattcccaactcagtatcagcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtttacagggagtctgcttccagtgctgctccgggaaggatcccatccaccagagctgccccacatggaccatggtcaggcagaggaagatgcctaccacaggcaagggataaagccagatga

SEQ ID NO: 861 - DNA, 355 bp, Homo sapiens
acaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtcccatgggattctaatctaggcaagcaagtctgcgctgaccccagtgagtcctgggtccaggagtacgtgtatgacctggaactgaactga

SEQ ID NO: 862 - DNA, 780 bp, Homo sapiens
gaaggacgcaggcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgcctgaggggtccagaagcttcgaggcccagcgacctcagtgggcccagtggggaggagcaggagcctgagccttgggaacatgcgtgtgacctccacagctacctcttctatggactggttattgccaaacagccacactgtgggactcttcttaacttaaattttaatttatttatactatttagtttttataatttatttttgatttcacagtgtgtttgtgattgtttgctctgagagttccccctgtcccctccaccttccctcacagtgtgtctggtgacaaccgagtggctgtcatcggcctgtgtaggcagtcatggcaccaaagccaccagactgacaaatgtgtatcagatgcttttgttcagggctgtgatcggcctggggaaataataaagatgttcttttaaacggt

SEQ ID NO: 863 - DNA, 2431 bp, Homo sapiens
atcacaaaggaggcccagaagccttcaggcagcctcaactcagccccaagccactgctctcccatcccagtccctggaaatccacccacttggcccagctcaccccaactccaacccactgggacccagtctccaggggcctgactgtgggcggcagccactcctgagtgagcaaaggttcctccgcggtgctctcccgtccagagccctgctgatggggaagtccgaaggcccagtggggatggtggagagcgccggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagctgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagtggagctggagacacagctggccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggtgcagctagcggcgacccagtgtacgtcccgccccggccaaccatgccaagcctgcctgccaggcctctgcgcctggcctagggtgcagccacctgcctgacacccagggatgagcagtgtccagtgcagtacctggaccggagccccctccacagacacccgcggggctcagtgcccccgtcacagctctgtagagacaatcaactgtgtcctgcccaccctccaaggtgcattgtcttccagtatctacagcttcagacttgagctaagtaaatgcttcaaag

SEQ ID NO: 864 - DNA, 2849 bp, Homo sapiens
actgctctcccatcccagtccctggaaatccacccacttggcccagctcaccccaactccaacccactgggacccagtctccaggggcctgactgtgggcggcagccactcctgagtgagcaaaggttcctccgcggtgctctcccgtccagagccctgctgatggggaagtccgaaggcccagtggggatggtggagagcgccggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagctgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggaccggccggctgtggagaaggccaggacgctgtaccgctcctgcatgaaccagagtgtgatagagaagcgaggctctcagcccctgctggacatcttggaggtggtgggaggctggccggtggcgatggacaggtggaacgagaccgtaggactcgagtgggagctggagcggcagctggcgctgatgaactcacagttcaacaggcgcgtcctcatcgacctcttcatctggaacgacgaccagaactccagccggcacatcatctacatagaccagcccaccttgggcatgccctcccgagagtactacttcaacggcggcagcaaccggaaggtgcgggaagcctacctgcagttcatggtgtcagtggccacgttgctgcgggaggatgcaaacctgcccagggacagctgcctggtgcaggaggacatggtgcaggtgctggagctggagacacagctggccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggtgcagctagcggcgacccagtgtacgtcccgccccggccaaccatgccaagcctgcctgccaggcctctgcgcctggcctagggtgcagccacctgcctgacacccagggatgagcagtgtccagtgcagtacctggaccggagccccctccacagacacccgcggggctcagtgcccccgtcacagctctgtagagacaatcaactgtgtcctgcccaccctccaaggtgcattgtcttccagtatctacagcttcagacttgagctaagtaaatgcttcaaa

SEQ ID NO: 865 - DNA, 1492 bp, Homo sapiens
gccactccacgacatccctaggccggcgacacgccgctctcaagcctgtggatgacccagcgccagaaaaccgggtggccgtcatgaagccctagcccagctccgcagcccctcaccttatagacggccacacaggctgaggtgcagcccaggtaaagaagcttgtgtaatcgcagaggaaggacataacagtttgagcctcactctgtcacccaggttggagtacagtggaacagtctcagctcactgcaacttccgtcttccaggctcaagtgatcctccctcctcagcctcctgagtagctggactacagtatgtaaagaattcttgaaccgattctacaagtcactgatagacagaggagttaacttttcgctggacactatagagaaagaattgatcagtttttgcttggacaccaaaggaaaagaaaaccgcctgtgctattatctaggagccacaaaagacgcagccacaaagatcctaagtgaagtcactcgcccaatgagtgtgcatatgcctgcaatgaagatttgtgagaagctgaagaagttggatagccagatctgtgagctgaaatatgaaaaaacactggacttggcatcagttgacctgcggaagatgagagtggcagagctgaagcagatcctgcatagctggggggaggagtgcagggcctgtgcagaaaaaactgactatgtgaatctcattcaagagctggcccccaagtatgcagcgacacaccccaaaacagagctctgatctccaatgccagcacatttgtgacttgtaattagagagaaaagtgactctctaggatatggacatgttgattaaggataactgggaatgcatcatatttggtctcatgctttttgtgttggtattattcctcagaattttgttacgtgggtttatgagtgaaactaatactactgataacttacatttgcagtgtaccaaaagctaaaagttcctttctcataagtttcttggaatgactatgccagttttcattgcctgtctcctaaaagtgacctactgacaaattgatggagtaaattgattccaagaaagaagaaggcattcagagactcctctctggatgcaattttaaaatatattggactaaaacaaaagacacaacagtcagcttatctaatgcacaacttcaatcccaaatacagaatcaaaagtttttttcaagtgaattttctgttttcactctatattgtagctctctttggtatcagaaatggtcaggcaggagtactcgtttttcccattggaagaaaacccacttaaacctacttaaagaaaatagagagatcaagaaaccgtataagtatagccaatgtttggcaattatatcaacatttacattgttaattgaaccaagctcaaggtctttttcattccttacagtcacatatcagacaagtttttgatggaagattaaagcatattaaaaacactcataggcaacttggaa

SEQ ID NO: 866 - DNA, 4493 bp, Homo sapiens
tctttccacctcccttccagtccgctcccggttcctggctccagctaggctcggcagaaataggagcgcgcaggcgcgacgtgcggctcgcagaacggcgagtagcggagcgggacccgctggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaagaga

SEQ ID NO: 867 - DNA, 2640 bp, Homo sapiens
tttccggcaaggttggaagccgctcttggaggtcgtgagcatctgcaaacatcccaaaacctttcaaccaaaatatgtatagatgagtgtgcagaccaaagtaaggacatcagtatgttacatttaaaaataagtcaaggttaaaggcggtgtcctcttttaagaacatcgcaaatacaattccagtactccaagtacgtattctgtacccagccacctgggaggactgagagacctaatggttttctgctttctggaacttctatgccaattgtgactttctcacccaaatttgtaaattcgcaaattaacatgcagcgaataattacaattgtaaacacctggaagtggaaaaggccgtgaggataaattgagaggaagagtaaacctaataccataagttgcataccagcagatctgagtatcgtcatgaataattggttagcttttccacatgccttagaagtttcagcaagcacctagcgaacatcttaatccaaatttctcaaaaaatgagagattttatttaagatcattcctcaatttatcttagactttcagctacatagttagtccggtagtgtaacagtaacgggttttacgtaaatgccaggggaaaagagaggaaagctaaataaccaagtaaatctgtatctaattaacaaattggctaaataaggtgttatcagctgcttgatatagagctgataaaatcttcagctaggcatacttgaggcctgattacagaagtgaccgtagtccacccacacacctgaaatttatttaagagaccaagctaggctcttcctggcctttaggaagaggactggcatggagaaatatgttcctcactagttctcccaagccatggcacgtcccaacaaattcctcctttggttttgctgctttgcctggctgtgttttcctattagccttggttctcaggcttctgggggagaagctcagattgctgctagtgctgagttggaatctggggctatgccttggtccttgctgcagcatatagatgagagagacagagctggcctccttcccgcgcttttcaaagttctatctgttgggcgaggtgggtcacctaggctgcagccagactccagagctttgcactacatgaagaagctctataagacatatgctaccaaggaagggattcctaaatccaatagaagtcacctctacaacactgttcggctcttcaccccctgtacccggcacaagcaggctcctggagaccaggtaacaggaatccttccatcagtggaactgctatttaacctggatcgcattactaccgttgaacacttactcaagtcagtcttgctgtacaatatcaacaactcagtttctttttcctctgctgtcaaatgtgtgtgcaatctaatgataaaggagccaaagtcttctagcaggactctcggcagagctccatactcatttacctttaactcacagtttgaatttggaaagaaacacaaatggattcagattgatgtgaccagcctccttcaacctttagtggcctccaacaagagaagtattcacatgtctataaattttacttgcatgaaagaccagctggagcatccttcagcacagaatggtttgtttaacatgactctggtgtccccctcactgatcttatatttgaatgacacaagtgctcaggcttatcacagctggtattcccttcactataaaaggaggccttcccagggtcctgaccaggagagaagtctgtctgcctatcctgtgggagaagaggctgctgaggatgggagatcttcccatcaccgtcaccgcagaggtcaggaaactgtcagttctgaattgaagaagcccttgggcccagcttccttcaatctgagtgaatacttcagacaatttcttcttccccaaaatgagtgtgagctccatgactttagacttagctttagtcagctgaagtgggacaactggattgtggctccgcacaggtacaaccctcgatactgtaaaggggactgtccaagggcagttggacatcggtatggctctccagttcacaccatggtacagaacatcatctatgagaagctggactcctcagtgccaagaccgtcatgtgtacctgccaaatacagccccttgagtgttttgaccattgagcccgatggctcaattgcctataaagagtacgaagatatgatagctacaaagtgcacctgtcgttaacaaatggtcctcttaaaaccttgagcctatttggcaaagtaactactgtgtgcctatgtgtgccttcaagagaaagcttcatatattaagtctctaaatgtagcatatgttatataaagaggagcctgtgtaggttagtaccttctatggcatctatcaggataaagggataacatcaattgttgctacagagcctttttttatttccaaatttaaatgaaatataattattgtggagaactttacatttttttccttgagtgattttttttcttttcataggagtcttattcttgatagggaaaaaaccttaattagcatcaatcctggatggacttgcagctataaataggcaattcagattgctgtagtcttaatagaagaataaatttctgtcaatggcataaa

SEQ ID NO: 868 - DNA, 826 bp, Homo sapiens
agtggggacccaaagggtgcaggacgcctggtctgccttgtgggtcctggacggagcccctacctctgcaaagatgacttggagacaggccgtcctgctgtcttgcttctccgccgtggtgctcctgtctatgctgagagagggaaccagtgtatctgtgggcaccatgcagatggcgggagaagaggcgagtgaagatgcaaaacagaagattttcatgcaggaatcagatgcctcgaatttcctcaagaggcgcggcaagcggtcccccaagtccagagatgaggtcaatgtggaaaacaggcagaagcttcgggttgatgagctgcggagagaatattacgaggaacaaaggaatgaatttgagaacttcgtggaggaacaaaacgatgagcaggaagagaggagccgggaggctgtggagcagtggcgccagtggcactatgacggcctgcacccatcctatctctacaaccgccaccacacctgatcccatcctgaagccggccaagaagacaaagcttgtagcaccattggcatccccgtgttccagcaatctttcccatgcaaaccggcccttcagagggtctcagcttggggtctgcagtggccagcagctcttgaaaagacgcatgcctttccttccagtgtgtgaaagtgtcctgactttcacctctttgcagaccatcttctgaggtgagcaactgcctgcagggcctcctagtaccaaacctacagtggcttcccctggcttcgttcccaagcaaaagaatcagtcaagaatcacatgtttgcttatggcttacaaataaaaacgctgaatcaa

SEQ ID NO: 869 - DNA, 885 bp, Homo sapiens
gcgtggtgcgggggcgtggggaaatcgggttgccccagccgttactggtccgcgcagtcagggcatcctccgcatcctccacatccttccatggctctgaagaataaattcagttgtttatggatcttgggtctgtgtttggtagccactacatcttccaaaatcccatccatcactgacccacactttatagacaactgcatagaagcccacaacgaatggcgtggcaaagtcaaccctcccgcggccgacatgaaatacatgatttgggataaaggtttagcaaagatggctaaagcatgggcaaaccagtgcaaatttgaacataatgactgtttggataaatcatataaatgctatgcagcttttgaatatgttggagaaaatatctggttaggtggaataaagtcattcacaccaagacatgccattacggcttggtataatgaaacccaattttatgattttgatagtctatcatgctccagagtctgtggccattatacacagttagtttgggccaattcattttatgtcggttgtgcagttgcaatgtgtcctaaccttgggggagcttcaactgcaatatttgtatgcaactacggacctgcaggaaattttgcaaatatgcctccttacgtaagaggagaatcttgctctctctgctcaaaagaagagaaatgtgtaaagaacctctgcaggactccacaacttattatacctaaccaaaatccatttctgaagccaacggggagagcacctcagcagacagcctttaatccattcagcttaggttttcttcttctgagaatcttttaatgtcatttatatacaaaagaaattctcaaatgttaaaataaaggaatagtttattgcttaatataa

SEQ ID NO: 870 - DNA, 2729 bp, Homo sapiens
cggagacagcggtgcgctcagctcccgggagcggcccgagcagccgagcgcccagggctgcccttcccgggccggcgggctccccgggctccccgccgccgccccgtgcgccccgggagggcccggcatgctgcgccagctgctgctcgccgcgctctgcctggcgggtcccccagcgcccgcgcgcgcctgccagctgccctccgagtggaggcccctgagcgagggctgccgcgccgagctggccgagaccatcgtgtacgccagggtgctggcgctgcaccccgaggcgcccggcctctacaaccacctgccctggcagtaccacgccggccaggggggcctcttctactcggccgaggtcgagatgctgtgcgaccaggcgtggggcagcatgctggaggtgcccgccggctccaggctcaacctcaccggcctgggctacttctcgtgccactcccacaccgtggtccaggactactcctatttcttcttcctcaggatggatgaaaattataacctcttgcctcacggagtcaatttccaagatgccatcttcccagacactcaagagaacagaaggatgttttctagccttttccagttttcaaactgttcgcaagggcagcagctggcgactttctccagtgactgggaaatccaggaagacagtaggctcatgtgctcctcggtgcagaaggccttgtttgaggaggaggaccacgtcaagaaactgcagcagaaagtggccaccctggagaagcgcaaccggcagctccgggagcgagtgaagaaggtcaagaggtccttgcggcaggcgcgtaagaagggccgccacctggagctggcgaaccagaaactcagtgagaagctggcggcgggcgcgctgccgcacatcaatgcccgggggcccgtgcgccccccctacctgcgggggtaacgggcctgggggctgccaggtgtgcagggccaatcctgacggtaattgagaatgagtgaggtttcgtacatgcagctatttcaagggttgtaagagtttttgtttttaatcacgcatttggtagagtctaaatggataaaatgcaaggcttgctttccccttgggtgctggcctcaatgtcagaccccacgcgctgccccttcctggcctgaccccagacgcagtgcctggcagtccagaggcagtgggatccctgagtgctgaatgctcgcctgcagagcagcccagaaagagccctgactggggagagaacattttagaatctctagtgtaaaagacatcaacgtgcttagcctttatttcagaaaaaaatcagggtggttcccagctccccagtccaggacaaccattagtcctgatgagtgagctgacgctggtgctggaacctgctggcacctcactggccacatctttggaaggggatggtggccttgcatccaagatgcctgaaaatcagcacgtgcagggcctccctatccagccagcattttccttccagctgaggcaggtgaagacttcataagctcatcacaggggagggaattaggagcagggcagcaggtaattaaacaagataaattatacctgatttccaacaccagctacaaagagttgaagatgatacctatgggtcgcgttaacacagggggcaactgccttgatcggcctgccatgggtcatcagactgcttcctaaattgagagaaactgagcaatctctcagccactgctatagtctaacttcttgtttgctgagtaattgtttctaatgtctctgaactcaaagtgaggtgctccaagacgctgtgaacttctgcaaagacacctccttacctactgggatcacgtgacctgacctcactcccagccaggctcccaaagggctcattccagccattccaatctcttcttctttatgcaaacacttttcccccacaacaagccttgtttgttccgataggaatacgtgtacgtcagtgcacttgtccttacgtcagttccttacaccaccaaagcacttcacctttctggaaataaaacttttaagacactactataagtaaaaatgagagtattcactagacttattgctcaggcacatttgagtgggtcccagctgtgtgattaagaagtcaactgggtggccttttctgggttatcttctgatcatggcctttcaacccaacaagggcccttccctgctcttccaccagtaaaggctcctggcctctcatcaggatctgccccccagagaccccccccagacactgcagggcctggtgatgctgtcctctgtaccggaaatggcaggcactgtcagatttccactcttctgcctttaggaaggctgggtgcttcttgctctgacagccagtctggggagatgactcttacgttgcttgagtcttggtggcaggctgctgtccacgggggagaagtctctgctctggactggacagaagagagacttttaccctggggcactcacacggccaagcttctgccaccacttcattagctgtattctccatagtatggtgaaatagcaggtgcgtcttctagtttattcctcctggggacatttcctcaaagcagttttgcgcccccgcaagggaatggtcagcctaagggtaatgtacagcccgtgcttggagaaccatggaagctacacccctacaggtgcatactgttctgcttttccaataaatacgagcggcgatttcaaccac

SEQ ID NO: 871 - DNA, 3180 bp, Homo sapiens
aatacactcaaaaagcagaaagcctgcaggatgcttcttgggctcttgttgcggacgaataggctcggctattcttgttgctgaagaatagcctctgctggtgtggaggagggaagctgcccccggattagacagcaggatgacaaggaaaaaggcagatgcgccctctcctggtatctccgaaggattctgcttcgctgtctggacctcctgctgcctggccaagcctgactctcaaccctgcccctgaggctaaccccaagagcagggcagagaagcaagcaagtcagcgactgccccagacccaattccgggccctcgagttggtgtggtgtaggaggggcagatgaggctagaggctgctttataaggagcagaaaagacggtgtcacagctgtaccctgggatcggcagaaaagggtccccccggggcctgtaaggggtgcctgcgtaacaggtgacttgaatttcaagtgattatcatataaatggaggattagaaaagagacaccaactctggaaccagttcaatggaattcttcaagagactgtaacttagtgcttacaaagacttggaatgatctacactgcatggtgtacctgttagaggaggtgacatcaaagctttaggtactgagagaggatacttcctactgtggaagggaagaaaagaaaaaagcaaagctacttcttggaagagcagtggagagaaaaatattgtttctttttcttgggaaattggcagaggcatgctgaagaaatcagctacagctgttctccacacctggataaatttttaataagaacttaacacacccgccctccagaaagggtggtctgaggtgtcgatggtgttgtctctcccagggctcttctgggcagccttctctgtgacctggagagcgaagagtctatttccatcacatttcagctgccaaactcccctttaaacgatggatgaaaattataacctcttgcctcacggagtcaatttccaagatgccatcttcccagacactcaagagaacagaaggatgttttctagccttttccagttttcaaactgttcgcaagggcagcagctggcgactttctccagtgactgggaaatccaggaagacagtaggctcatgtgctcctcggtgcagaaggccttgtttgaggaggaggaccacgtcaagaaactgcagcagaaagtggccaccctggagaagcgcaaccggcagctccgggagcgagtgaagaaggtcaagaggtccttgcggcaggcgcgtaagaagggccgccacctggagctggcgaaccagaaactcagtgagaagctggcggcgggcgcgctgccgcacatcaatgcccgggggcccgtgcgccccccctacctgcgggggtaacgggcctgggggctgccaggtgtgcagggccaatcctgacggtaattgagaatgagtgaggtttcgtacatgcagctatttcaagggttgtaagagtttttgtttttaatcacgcatttggtagagtctaaatggataaaatgcaaggcttgctttccccttgggtgctggcctcaatgtcagaccccacgcgctgccccttcctggcctgaccccagacgcagtgcctggcagtccagaggcagtgggatccctgagtgctgaatgctcgcctgcagagcagcccagaaagagccctgactggggagagaacattttagaatctctagtgtaaaagacatcaacgtgcttagcctttatttcagaaaaaaatcagggtggttcccagctccccagtccaggacaaccattagtcctgatgagtgagctgacgctggtgctggaacctgctggcacctcactggccacatctttggaaggggatggtggccttgcatccaagatgcctgaaaatcagcacgtgcagggcctccctatccagccagcattttccttccagctgaggcaggtgaagacttcataagctcatcacaggggagggaattaggagcagggcagcaggtaattaaacaagataaattatacctgatttccaacaccagctacaaagagttgaagatgatacctatgggtcgcgttaacacagggggcaactgccttgatcggcctgccatgggtcatcagactgcttcctaaattgagagaaactgagcaatctctcagccactgctatagtctaacttcttgtttgctgagtaattgtttctaatgtctctgaactcaaagtgaggtgctccaagacgctgtgaacttctgcaaagacacctccttacctactgggatcacgtgacctgacctcactcccagccaggctcccaaagggctcattccagccattccaatctcttcttctttatgcaaacacttttcccccacaacaagccttgtttgttccgataggaatacgtgtacgtcagtgcacttgtccttacgtcagttccttacaccaccaaagcacttcacctttctggaaataaaacttttaagacactactataagtaaaaatgagagtattcactagacttattgctcaggcacatttgagtgggtcccagctgtgtgattaagaagtcaactgggtggccttttctgggttatcttctgatcatggcctttcaacccaacaagggcccttccctgctcttccaccagtaaaggctcctggcctctcatcaggatctgccccccagagaccccccccagacactgcagggcctggtgatgctgtcctctgtaccggaaatggcaggcactgtcagatttccactcttctgcctttaggaaggctgggtgcttcttgctctgacagccagtctggggagatgactcttacgttgcttgagtcttggtggcaggctgctgtccacgggggagaagtctctgctctggactggacagaagagagacttttaccctggggcactcacacggccaagcttctgccaccacttcattagctgtattctccatagtatggtgaaatagcaggtgcgtcttctagtttattcctcctggggacatttcctcaaagcagttttgcgcccccgcaagggaatggtcagcctaagggtaatgtacagcccgtgcttggagaaccatggaagctacacccctacaggtgcatactgttctgcttttccaataaatacgagcggcgatttcaaccac

SEQ ID NO: 872 - DNA, 2374 bp, Homo sapiens
gcaccagccgcggcaaggatggagctgggttgctggacgcagttggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgccatgctcctcatccccttgtttccatgacggcacgtgcgtccttgacaaggctggatcttacaagtgtgcctgcttggcaggctatactgggcagcgctgtgaaaatctccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttgggctgtgccagggcttctgacttcagggacaaaactcagtgaagggtgagtagacctccattgctggtaggctgatgccgcgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactac

SEQ ID NO: 873 - DNA, 3143 bp, Homo sapiens
agggcaaagccagctcccgtctcagcctcccgtaggaagatctcccggcctcacctgagcgccccgcagccctgggtacctctgctcccgcccagggtcctatggcccctcctcccagcacccaacactgggaccccacctgtacccaggctggcctccctcccccgcagcttcctttgcagccgccgtccgcgggtctccaggcgtggccacacctcccggggccccgcaagggttaaggcagcagagaggagaggtttgggctgacgtcgctctggctgaaggtggttcccctcagatgaggatgggagagcctggcgagctgaaacccgagctcccgctcagctggggctcggggaggtccctgtaaaacccgcctgcccccggcctccctgggtccctcctctccctccccagtagacgctcgggcaccagccgcggcaaggatggagctgggttgctggacgcagttggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgcgatgtggccaggttctgcgagccccaaagggtcagattttgttggaaagctatcccctaaatgctcactgtgaatggaccattcatgctaaacctgggtttgtcatccaactaagatttgtcatgttgagcctggagtttgactacatgtgccagtatgactatgttgaggttcgtgatggagacaaccgcgatggccagatcatcaagcgtgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatctccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttgggctgtgccagggcttctgacttcagggacaaaactcagtgaagggtgagtagacctccattgctggtaggctgatgccgcgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactacaaaacaaa

SEQ ID NO: 874 - DNA, 1921 bp, Homo sapiens
cgcctccgccttcggaggctgacgcgcccgggcgccgttccaggcctgtgcagggcggatcggcagccgcctggcggcgatccagggcggtgcggggcctgggcgggagccgggaggcgcggccggcatggaggcgctgctgctgggcgcggggttgctgctgggcgcttacgtgcttgtctactacaacctggtgaaggccccgccgtgcggcggcatgggcaacctgcggggccgcacggccgtggtcacgggcgccaacagcggcatcggaaagatgacggcgctggagctggcgcgccggggagcgcgcgtggtgctggcctgccgcagccaggagcgcggggaggcggctgccttcgacctccgccaggagagtgggaacaatgaggtcatcttcatggccttggacttggccagtctggcctcggtgcgggcctttgccactgcctttctgagctctgagccacggttggacatcctcatccacaatgccggtatcagttcctgtggccggacccgtgaggcgtttaacctgctgcttcgggtgaaccatatcggtccctttctgctgacacatctgctgctgccttgcctgaaggcatgtgcccctagccgcgtggtggtggtagcctcagctgcccactgtcggggacgtcttgacttcaaacgcctggaccgcccagtggtgggctggcggcaggagctgcgggcatatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgaa

SEQ ID NO: 875 - DNA, 381 bp, Homo sapiens
atgatttcattccatgtaatatttttgtcattaggaagaggcaagttatttttacctgtcaatttctgttttttgaaattgaaaaattctcaggtacgaatcccaaaagactttacatgcaacctccatgtcctattcaggactgttcaaggagaagacagaaacaccatgtttagaggtcattggtccatctactctagaaacttccccttggcagtggtccctgcctatgttacagaagacggcaaaaatacgagccatcgtgcatctggccagttctgcaatgctctatcccagggggaaattccttcctcactccagctggtgaacagctatgccctggagcccaggacggacatgccttgtaactttttaacttag

SEQ ID NO: 876 - DNA, 1304 bp, Homo sapiens
gcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagca

SEQ ID NO: 877 - DNA, 4757 bp, Homo sapiens
gtactgtccactgtgctgtcggtgctgaacctgagacgcgagcggaccagttgctccagcacctgaaggcaacgccctcttgcaccctctgtgccctgtgggacccgcttcaccaacaggacccatatcaacttgacaaaggagtgtggtatcggacgtgggagagagtcctctgtttgccacctgggcgctcattcaggcgtgactttggagatttctatagttttagaccaaactatttttttttccccagctaagacgatcttttgagagttttttttttttattgtgatttatatttccacagcgtttaggaatctttctgggggacttttgtgactgttaaaataaggtgaaaagcaataaggatgtttaagtgctggtcagttgtcttggttctcggattcatttttctggagtcggaaggaaggccaaccaaagaaggaggatatggccttaaatcctatcagcctctaatgagattgcgacataaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagaccctagctaacatattatggagagaagaaggtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaaaaaccctacgatacaattattgaatgaagcgttttacaatacattgcacttaatccattgtttaaatttacaacttaactttccaagtttatatcctagtcaaacaaaatttacttggttggtccaaataaaataaattgtttttgactaagtgactaagacatacacaattaattatattggttaattagaaatactcagcacaatatttaatgagaaatcacatcagtcacaagaatcaaatatgtaaattatgctttaaacaataaagtaggatttaaatcatttaaaaaactaaactgcagggaatttcagatgacataaagcattatttcattttgagggtagtttattttttttctctgtccttttggtatgattaaacaagaaataaaaggtgttgtggaaacttaaaattcttaattcaaaatattcggtcctgtccactgtttataatattttgtgccttgaagggaatgtcacaggaggaaaaggaagactaaagcctgcatactaaatgctctcataactataaatctcttgttgttaaaaaacatctcttgcaccaaatcctgtcttcagtcttttgtttaaccctcaatgaactaccaattgaaggcataagttggtcttaggttgtatacaggtgtcaaactccacttgacatttactgtataatctgcagcatgctatagaaagtggggaggaagggaggaaaaataattacagtcaaaatatttgcaatctatctactcattttgctttcaatcactagagtgcattatgtttttaatgcaagtttgtctgggatgtcaactgcctacagatgtttattactagcagaatagattatttattaatagattgtttcttttcatatagtccaatgtttcatcatcaggaactttcggttttaaaaaagaaacattacttttgtctgctaaagtaaaccatatatagggaaattaacacctaggaaaagaaaactggcaagagaattgatgaggtattagtggcttagaagaattagtaatataagttgggaataaaggggtagcccgacagtggtaagtaaaaatgtagtactccattgtttttgctatttaaatataatgtatcaaaaacctttattctaaaatttccacaaatgattccttttatccatcttcttgtaatcctaaaagcatcttctcactatgtgctgtagtttgaaacctaacgaatcctcctacttgagacactgtagaaaagtaaaaattgttgcttctgttttgttttaagaggaaatgagaaggccagcagaagtagattaaaactagagagctggtttattaaaataagcagataattatccaggcttaaagtaatagcttacatgttttgaaaatccttgtacttatttttgtttttattgttgcaaaaaaatgttaatgggctgttgaaatgacctccatttacttaaggtaatccaataaggtcttttttaaatatacaaattttactcaagtttaaattgtataaaactgcttagaaacctgaaattttatagtgtgtaatatcttatgtgtatatagcatcctgagctgtgtgatacagtagatttcttcttagcagaaacatgcgaggtagatttaataaacaacaaaaatcagcttatgtttctacttattgaatctgctttactttttagcaattttcttccttgtgaacatgaaccatataaagtgtctgtgacttaatgatttcatgtaagtctgtcgcatacatccttcttttgtagcttacaccatgtggatgctctgtctgtagacactgcttgataaaaggagaataaacctcttacatttt

SEQ ID NO: 878 - DNA, 426 bp, Homo sapiens
gctgggaccagactccgctgtcatgagggtgacatccgccacctgtgctcttctgctggctctgatctgcagcgtccagctgggggatgcctgcctggatatcgataaactgcttgcgaatgttgtgtttgatgtgtcccaagacctcctgaaggaggagcttgctcgttacaaccccagtcccctgacagaggagtccttcctcaatgtccagcaatgctttgccaatgtctccgtgacagaaagatttgctcattcagttgttattaagaagatccttcagagcaacgattgcatagaagcagccttctgatctgaggacccctgcagatcagatattggccctcctgccttccttggggctccccgcgttcctggcctggctctgttcatcactacagagaccccaatgaacacctgcagctc

SEQ ID NO: 879 - DNA, 2525 bp, Homo sapiens
tagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatgaca

SEQ ID NO: 880 - DNA, 2810 bp, Homo sapiens
aattcagcactaaaaccagtgtgagaagcagtatgtgtgagcatgtgtgtgtgtgtatgtgtgtgggggggggtgtaaaatgtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggagagatggactcatggaaacctggatcggtccttttagatgaaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatga

SEQ ID NO: 881 - DNA, 2468 bp, Homo sapiens
actgccctaacagagcaggtggggaatgttctgtttactccacttgtgcttctatttggccaacttcgcctcttcaattaaaaggacacatgctgttaacgggtgctgtggattacagatgatcgcactctgggcacagtcctctggaaatgcagatgcccgtgtggaggaaattctggcgggagaggagcggcgactcgccgctctgcttggatctcaaggcatgaggttctgggtgtgcctcgcagcctgcagagccatgtggggccttgctgccagacgaggacgggctgaagacagcagctcgtctccagtggacgcctccaagttcccatggaggggtgggcagcatcgcaccaccatgatgccttgtctgctgcgggtgggagttttcaggccctgtcatgtgagacccacgggggatccttcctgcgatgtgcagcctccacgactcggcttctccagagtgccagatacacaggtggcattttatggcagtggtcactgggacccaactcccttctctgtacacagctgtttttttaatttccaggtcagaaaaattatcttcctactttgaactctttctcctttttgccaaaaatgtttctctcttacaatgcagaagcagaacacagctcctgctcttgaaatactggatggatgtttcagagggtattgtgaggcttggagctccagccagtgacattccagccacatccttctctcctggctccacttcacagaggctggctgtgtctctggactacacctcagagctaatctgctttctggaagggtcgtgtttacttctgctggtgctgtgcatgtaggagacagctgtggccagccctgtttccctggggaggtggcagaggcggtaccatgagcaagggatgcagatgctcaagggggaccagtcaggggacacggggagggtttggcctctccagccaggggctcgccacctccatggtataaacatccatgtgaacaaaaaagttctaacaagtaccagcacactgagaatattttaaaccacaactatcgtggaaaatctgggagggtggttcctaggtccagggtggaaaagtagctgaaaacctggtagggtttgaagaacaatcagaggcggccttccacttctgagaacagttcctgtgagtcacctgatgttgttctagattaattctatcaaagacagtgttggtcaacccagctgcaggcacttgatttcctctaaaagctctggataacagaagcagagctgtgaagaaagtcaagttgaataaaatgcttccacttaaaagaatagggcttttccttgaaatggtccactggatcgaccatttcctctcatttattattattatcatctccattcccatgcatgctatttagacaaggaaggctggaagcaagtgacaggtgcggcagtgcgcagcaaggcctctgcacctggcccgtcagtagggccggcacgcagcctgactactgagtttcttctgcctcattcctctccagaggccctcaacttacaatagagacccaggagctgggagatgactgaatctgttaacatgacacagaaggactaacccataaacatgagcgtgaatgtcttttgttgggggactaaggagatgacactgaaaaggagaatcacaagccaagtgccataagcagaccacattccctgcaagctgccctgctaggctttatcccaaatcaaagaaaaagggagaatgtcttaatattctcacagatttgtaaccacttcactggggtaagttttcctttgtatagatgacggattatccttctaagctgcaagctgataaatgagaagctaagtataaaatatctagaactaaggtagatgaagatgtctatatgtgcactgggtgtcacttatatatctgcctgtgttattaagggcacaaaggttgtgtggggctgtgtaaactatagatattaggaatacagattaaaacagtaatttcacaatgcaagtagtgccaagccacgaaaatatgcctggagcatcttctcttttctctacttcacagaaaatatttccatagacacttttcaccaggcatctgcagctgtttttttttttttaaacaatcataattttaagcactatatggtaagccatttggaagccattcgaattatgcattaaaacaaggaaaaataagatgccacttgacatacactgaaacacataaaatcagatacagactcttgggtggaaaaagtatgttcttcaacttagttcagatgttaacatataaaacatgctcagggaaccctgaaaaaatccagaggtgaacactctgatggtcaatcacatgtgttccttcttctgatctggatgattcttacatttttagggcgctgtactgttttttagccctttgactcattaatgtatcagggaataaaaaggatatcaaactcaa

SEQ ID NO: 882 - DNA, 8061 bp, Homo sapiens
acttcataaagactctatgtggaggatagatgctaccgtggccgggctctcagccacgttcttctgcagtatgcagtagggaagggcacatttctcacatgccttcaccagattatagttttctgggagcaaagccaagtgctcccacctttgggtgctgacccaagaagagatattctgtgaacttctgctctttggttgggcaatctccgagagtcagttggttgggcatcggcaagaacgtcatctgcgaccgcacggccacgccgctggacgctttccgcatgacctcggccgcccactactaccccaagctcatgagcatcatgggcaacgtgctgcgcttcctgccggctttcgtgcgcatgaagcagctgatcgaggagggctacgtgggcgagccgctggtgtgtgaggtgcaggtgcacggcggcagcctgctgggcaagaagtacaactggagctgcgacgacttgatgggcggcggcggcctgcactccgtgggcacctacatcatcgacctgctcaccttcctcaccggccaaaaggccgtcaaggtccacgggctgctcaagaccttcgtgaagcagactgaccacatcaagggcatccgacagatcaccagcgatgacttctgcaccttccagatggtgctggagggcggggtgtgctgcaccgtcaccctcaacttcaacgtgcccggcgagttcaagcaggatgtcactgtggtgggctcagccgggcgcctgctggccgtgggcaccgacctgtacgggcagcgcaacagcgccccggagcaggagctgctggtgcaggacgccacgccggtgagcaactccctgcttccggagaaggccttcagcgacatcccctcgccctacctgcgcggcaccatcaagatgatgcaggcggtgcgccaggccttccaggaccaggacgaccggcgcacgtgggatgggcggcccctcaccatggccgccaccttcgacgactgcctgtatgccttgtgcgtggtggacaccatcaagaggtccagccagacgggcgagtggcagaacattgccatcatgaccgaggagccggagctgagccccgcctacctgatcagcgaggccatgcgccgcagcaggatgtccctctactgttagcacagattgagaacctcggggacttgagccttctgcaggggatgtccacagagagggaagggccgaggggagagggtgaccatggggaatgtggggatcagggaggtggagggacagtgtgaataaatggcatctaggaaggtaaactccaatcccggtgaccgaccccaaaccagactgttggtgggctgagctcctagcctggaagcattcaggagagcctgccattcctgggatgatccctgctgggtatttgcacgagagtggtttggtttagctgcctctgctgccctttactgtgacaagcaaggaggggttgcttccctccctacctcatccatcccacacaccttggccttctgcaagccaagtggttctgcaaggtcaaggcactagtatcagatggcaagctcagtgcccgggatacccactgctggcaggagaaggcccattttcacagtccacagaagcgtgttaggctggggttgggggtgggatgggctggtgagaaagttcaaattccaggaagccactttttattggatataaggtatctaacggcaaaagtacttagtagcaaagtggccaccttttgattgattgggcttcctcataggaagcactgagggtgtgtctttgtacttggttcattgcccttcacctggtagagaaagagaggtcagaaatagcaagcaaaaagcaggactcccaggagccacaagaaaagagcacaggctgcaccaaagcaggggcagcagagaataaaatatccctttgaacttgtcaacaattaaaaaactgcaaggagtcaccttataacactatttccagtaaaggtggaattgagtatcagagggattactgcggtgttaaggtagccctgccacgtggctctccaggcagggccaagaagacagcacaaagtatgggtttggccataagctcatatgctgcccccaaagactggggagagctgtgtgcctcagtgttgcagtgtgaattcctaaatagagggtaaagtgagcctagccaggaggtgtttggggctctatcgcgcatctctcctaccaagctgggcaagagcttttaggagattcatccagctttgtggatttagaaaggaagccttcagttccaatcagaatcctctttccttacaaaaaaaaaaaaaaaaaaaaaaaaaaaaaggattttccttagctccagcatttgctttcaggattctgacacctgagaatttgggggtaggtactaaacgaaacaaaacaaaaggacaacaaggaacattatttctagtgtttctaaaatgggggtttagaaccccttaaggggccatacttaggcttgaaaaggctaatgttggaaaaaacatgttcttctaattggtctgctgtctgtcttgtccttgcacactctgcttacagagttttgttagagatgctgaactgcaggctgggagcaggcagtgccaaaagggaacagacacacacacacatgcacgtgcacacacacacacacacacacacacacagatttttgaatggttgctaccgacaaatgtcgctgaaaccattctttaaaaattcagatctggtcttgaaagaaagagccaatcaagtgcattcagagaacagggaattatcctttgttatctttgtttaattcttcaccccacgtaagacatttgtcaagtgtggacgtggaagccattcctcataagtctacgtagcttttgttcacaggctcactgaagtccaacaggtgtctttacatgcaactgaggtttagagttcttttcagatagctgccattggaactagaagggaatctaagaggactggagtccacctccagcctgtgtaggcaaaatctgagaatgaacagcccaatcagttgcatccttcattgtcctccctagggtcaatattctttgaagcccaggctactcataggtgcaagtgtggtgtgtccaaacacgaggggaatgctgggcattttctagaacagagaagtaagtactgccttcctggaaagagtcgccctgcttcccgaggctttgctacagcactgcagggtgggtaagctgaaattccatgcgtggtttgttgtggtccctgacctgttgctgacagacttcatggtcagcattccagctcttgcagctatcagttccaaaccagagatttgctggaatggaagtctcccaataatagtttgaacagaggcccatgtcatggactgctttggttcacattcttcttctttttttttttttttttttgaaatggagtctcgctctgtcacccaagctggagtgcagtggtgtgatctcagctcactgcaacctctgcctcccaggttcaagcgattctcctgtctcagcctcccgagcagcagggactacgggtggctgccaccacagccggctaattttttgtatttttagtagagacggggtttcactgtattagccagcatggtctcgatctcctgacctcttgatccacctgccttggccttgcaaagtgctggggttgcaggcgtgagccaccacacccagctgattctggttcttctaaattgctccctgggaaagtagtttttggggaaacattggaattattattattattattttctagctagcctgaagggctccgattaaggatgaagggaaagtaaacaaaatgattcaatgggtttcatttttctaagtcattcataacctaaatagggatattcctggggtttcaattgtatgtttctgtactaaaccataatactcgcgaaatcttttcccaaaacttcgggttttggagagaggtccccacaaaggcctctaagctctgtaatacatatttaatgtctaaaacaaaaaatctcatttgaagctggggtattagaaagaacatatattctttaaaagaggcatgaaaaaatattttagtgtgtgtactcaaattttatctactgaaatgcatgtagtaggtaggtgaaggaacaagagaaagaaaagaactggatagttcattttctttaaatataaactgtagcaaatgggtttgagatactcctttagtgctccatttgcccttatcccaccacatgcaaagacttgatttggggtagctatatgaagctgaaatctctagccttcaacagtgttctgcagaaggactttgtttcagcccagcaccgttcatcatgcctttaggggtctgggtacccacagctgactttgacctaggactaaaacccagcaatcttttggctcctttctgctttgtttaatgtgtttcaagggcctcgatgcaaggaggcagtgctttaagagtcttcccatttagttcctgcatgcctgtttcgttcccatcaatgtgcgaatggcctagattccaagttatgagggagggtgtgggtcagggttcttacctggtatttaaaaaatgtttgggagtgccctgggcctatttgaaaagtttgaatctgtgatcactgtcagctcctccaagacttctcctctcaacagacaattgcattgtagggcaccccagaccccccttagcctacatggcagcaaataccactgtgccagttatatctggactctagggtagtcttggccaactccaagactggccaactccaagacttgtccactgtgtgcagagtattttaagtatgttatctcatacaatccataaaaacaaccctatagtgttgggtattgctatttcttttatacacatgagaaaatggaggcagtaagaggaagaggaacttgttcaaagtcacacaactgttaggcagaaatgaggtcattcaaatccttaatcttctcctccagaccacactgcctcccaggaagagatgtgggcacctcctgttcttgccaggcaggaaaccgctccttatcaatgtctacggggtctgctctcacacccaggaaggactgtgacaagcatggactaacctgcggctccactcagcctgctgtcagcaccctcctgttcagcaggatgcaacatctgatgttctgccaggaggctgtagagctgcacatagaagtagccagtgtttcttcccattccaaaatggaaatatcactcagccttttttaaaattgacttcctatgttcattttgattgtaggtgatgcagcaagcctcagggctggggattttcaaaatcttgttggctgactattatagatggccttggaatttgctcttgggggtctgaatataacgtaggaaaatgtcctttctcagggagtggggctttaaagttcgtttgtttgtcactccaattttagctgtgcactgcacctttctttgcacccctactctcttcatcttgtctcatagccacagctattgaatttggcctgtgatcataagttgggtttctgatctgatctcttgcattctggtgggtactgggggcagaatcagctttgttaatgattttctgggcagaaggtaaattcagctgcatctgaaggggcttcacagtccaatagccgtccttttgttttacataacagagagtgatggtcaaggccacccacatctttagtggtagagccaggacaaaaagtcaggttttctgcctcttaagtctcatgctgcctcacatagcacctccagagctctagggaaaggaggctcagagagatgaagtgacttgtctgaagtcctgtggctagtggcagagaagttggaattagacctgcattggacctcaattcgctgagcagttgcagggaaatctggaaatccttttttttttttttttgagacagagtcttactctgtcacccaggctggagtgcaatggcgtgatctcagctcactgcaacaccgcctcccgggttcaagcgattctcctgcctcagcctcctgagtagctgggattacagacgcacgccaccatgcccggctaatttttgtatttttagtagagacaaggtttccccatattggtcaggctggtcttgaactcctgaccttgtgatccgcccgccttgacctcccaaagtgctgggatgacaggcgtgatccaccgtgcccagccgggaaatccattttttaaaataaattcaattatgtcttgaatgtactcagaaaacgagctgtttaaaatgtcccattgtgactgtaatgtgaacaatgacctctaacttgtattttatttggcaaggatgggggatgtgcatcaaatcttcacctctgggatttcctgaggcttggtctacttggctcaccctccacctgcatccccaccccactcctagatattaatacaaatctagccttgacaccgcctactgctccaccaccgcctacgtttttggccatcagagccttggagtttacagagcagaggccatgacattggggagcttgtttaaaaatcaatgatcagaaccccacattttagtttccttttggggagaaagaggagggccgtggaagaaaaggggtgtgcagctggagcgttattatgtctttctcagcggcaggcatgcccgcctctccaccttctccccgccaggcacaggagccagcagctggagcgtgctctgagtttcaggggaccccccacccagactgactggggcttctgggacttctcataggaagagtcaagacctcctgcgcttctttaaaaggtgatgggctcagtgttcccagtggcatctggaggtgaagccggtactgtctcaggagtggaaggcaatggcccactggcctttttctcccccacgtcacagtccccatttgctggagcccttgagggggccaccgaaactgtggctctcattcagcctcccaaagtgttgcactactgaatactcctttctgtttacaccagcagtgaatagagtcatgaaaagaacatattatatgcaatggcttgatgcttagtgtggcaatcaaaagcttgcctgggcagatgtaggcaggggctagacaatagtcatggagttgtcaccaggtcactgtctctctccttccccttccaggtctctactgtcccctgcagccaccacaagggctaagctgttgaatgagccccttggtttttccttataaacgcaatgacttacttgtgattcttggtctaatcccaggctaagaaacaaaacaaaagcttgtgatctgacccattcctttgctgccttccttctctttcaggcacctggacgtatttagtattctgccctgtgccttgcccaggggagggagaagtttctagcaaatgtgactttctgtctgctgcctggtgcttttatagtacttcatctgctttttattgttgttgttgtgttttttaaccaaaatggcatttgtttggctgtcattgtcgagtatatatttattgtgttttacaaacatgagtatatatgtatgtatatgtataaaaccaaacttatatatataagaagtcaaggcatgtatactagatattttaaagagttatttatcaagggaaaaagatgtgtgttataaagtaaacagagtctatattttctatataatgtagatagtcaaacatagcttataaattataggaggttttggttttcttttttattattaaaggaaaaaaagaagaaaaaaaaagacaatgaatgcaactgttcttagtgtttttaaggccaaactactgtggaagctgggaggcggccctccctgcgggcctccagcagccctgtgcctgccgctaggagctccagagctgatgcccgttgtgatctctgcgatgctcgatgctcggagccagcggtcagcatcactcagccagctggcctgtgccgctctgacgtggcttccagctgttctccgcaatttgcattggtgggataaaggaatgaaaaggataaataaagatttaaaagaaaatacaa

SEQ ID NO: 883 - DNA, 8751 bp, Homo sapiens
gagcgaacatggcagcagaatgaggaggctggcgccgggtcgtggccgccgctgccgcgctgcagctcgggatcccagtccggcgcgctccgggccgcatccttagccggcctcctggcggccgcgggattatttcattcccaacggagagctaggaagaaaggagactcccccgcggagcggttccgtgctctggcagggtgtagacgtttgtctgtgcgattcgccggctgcgcaaacgacgcgggagagagccggtcccgggctgcggcggcgcggccgcggggatgagccggccatggagcggccttggcggggcgcacgcagcggactggcgctgccgcgggagcgcagcctgagccggggctccagggggcttcgaagcctccggcgccctgggggggtccctgccgccgactccgggaaggacgcgagccccgcgtggcggacactgccgcagtcaccgttctgaggcgccccgagcttgctccgcctgcagctcggtgcgctctgggcacccgggcgccttgcccggtgcacggcggctggcgcaccgcggctagattggctacaggagcggggtgcaggactggctagaggtgggtgtgtgcgcgcgttggactggagatccgagcagaagcagaaccaggcggctctgagcagccatgcttcccggggtgggcgtgttcggcaccagcctcacggcccgtgtcatcatcccgctgctgaaagacgagggcttcgcggtgaaggcgctgtggggccgcacgcaggaagaagcggaggagctggccaaggagatgagtgtccccttctacactagccgcattgatgaggtgctgctgcatcaggacgtggacttggtgtgcattaacctgccgccgcccctcaccagacagatcgctgtcaaaaccctaggcatcggcaagaacgtcatctgcgaccgcacggccacgccgctggacgctttccgcatgacctcggccgcccactactaccccaagctcatgagcatcatgggcaacgtgctgcgcttcctgccggctttcgtgcgcatgaagcagctgatcgaggagggctacgtgggcgagccgctggtgtgtgaggtgcaggtgcacggcggcagcctgctgggcaagaagtacaactggagctgcgacgacttgatgggcggcggcggcctgcactccgtgggcacctacatcatcgacctgctcaccttcctcaccggccaaaaggccgtcaaggtccacgggctgctcaagaccttcgtgaagcagactgaccacatcaagggcatccgacagatcaccagcgatgacttctgcaccttccagatggtgctggagggcggggtgtgctgcaccgtcaccctcaacttcaacgtgcccggcgagttcaagcaggatgtcactgtggtgggctcagccgggcgcctgctggccgtgggcaccgacctgtacgggcagcgcaacagcgccccggagcaggagctgctggtgcaggacgccacgccggtgagcaactccctgcttccggagaaggccttcagcgacatcccctcgccctacctgcgcggcaccatcaagatgatgcaggcggtgcgccaggccttccaggaccaggacgaccggcgcacgtgggatgggcggcccctcaccatggccgccaccttcgacgactgcctgtatgccttgtgcgtggtggacaccatcaagaggtccagccagacgggcgagtggcagaacattgccatcatgaccgaggagccggagctgagccccgcctacctgatcagcgaggccatgcgccgcagcaggatgtccctctactgttagcacagattgagaacctcggggacttgagccttctgcaggggatgtccacagagagggaagggccgaggggagagggtgaccatggggaatgtggggatcagggaggtggagggacagtgtgaataaatggcatctaggaaggtaaactccaatcccggtgaccgaccccaaaccagactgttggtgggctgagctcctagcctggaagcattcaggagagcctgccattcctgggatgatccctgctgggtatttgcacgagagtggtttggtttagctgcctctgctgccctttactgtgacaagcaaggaggggttgcttccctccctacctcatccatcccacacaccttggccttctgcaagccaagtggttctgcaaggtcaaggcactagtatcagatggcaagctcagtgcccgggatacccactgctggcaggagaaggcccattttcacagtccacagaagcgtgttaggctggggttgggggtgggatgggctggtgagaaagttcaaattccaggaagccactttttattggatataaggtatctaacggcaaaagtacttagtagcaaagtggccaccttttgattgattgggcttcctcataggaagcactgagggtgtgtctttgtacttggttcattgcccttcacctggtagagaaagagaggtcagaaatagcaagcaaaaagcaggactcccaggagccacaagaaaagagcacaggctgcaccaaagcaggggcagcagagaataaaatatccctttgaacttgtcaacaattaaaaaactgcaaggagtcaccttataacactatttccagtaaaggtggaattgagtatcagagggattactgcggtgttaaggtagccctgccacgtggctctccaggcagggccaagaagacagcacaaagtatgggtttggccataagctcatatgctgcccccaaagactggggagagctgtgtgcctcagtgttgcagtgtgaattcctaaatagagggtaaagtgagcctagccaggaggtgtttggggctctatcgcgcatctctcctaccaagctgggcaagagcttttaggagattcatccagctttgtggatttagaaaggaagccttcagttccaatcagaatcctctttccttacaaaaaaaaaaaaaaaaaaaaaaaaaaaaaggattttccttagctccagcatttgctttcaggattctgacacctgagaatttgggggtaggtactaaacgaaacaaaacaaaaggacaacaaggaacattatttctagtgtttctaaaatgggggtttagaaccccttaaggggccatacttaggcttgaaaaggctaatgttggaaaaaacatgttcttctaattggtctgctgtctgtcttgtccttgcacactctgcttacagagttttgttagagatgctgaactgcaggctgggagcaggcagtgccaaaagggaacagacacacacacacatgcacgtgcacacacacacacacacacacacacacagatttttgaatggttgctaccgacaaatgtcgctgaaaccattctttaaaaattcagatctggtcttgaaagaaagagccaatcaagtgcattcagagaacagggaattatcctttgttatctttgtttaattcttcaccccacgtaagacatttgtcaagtgtggacgtggaagccattcctcataagtctacgtagcttttgttcacaggctcactgaagtccaacaggtgtctttacatgcaactgaggtttagagttcttttcagatagctgccattggaactagaagggaatctaagaggactggagtccacctccagcctgtgtaggcaaaatctgagaatgaacagcccaatcagttgcatccttcattgtcctccctagggtcaatattctttgaagcccaggctactcataggtgcaagtgtggtgtgtccaaacacgaggggaatgctgggcattttctagaacagagaagtaagtactgccttcctggaaagagtcgccctgcttcccgaggctttgctacagcactgcagggtgggtaagctgaaattccatgcgtggtttgttgtggtccctgacctgttgctgacagacttcatggtcagcattccagctcttgcagctatcagttccaaaccagagatttgctggaatggaagtctcccaataatagtttgaacagaggcccatgtcatggactgctttggttcacattcttcttctttttttttttttttttttgaaatggagtctcgctctgtcacccaagctggagtgcagtggtgtgatctcagctcactgcaacctctgcctcccaggttcaagcgattctcctgtctcagcctcccgagcagcagggactacgggtggctgccaccacagccggctaattttttgtatttttagtagagacggggtttcactgtattagccagcatggtctcgatctcctgacctcttgatccacctgccttggccttgcaaagtgctggggttgcaggcgtgagccaccacacccagctgattctggttcttctaaattgctccctgggaaagtagtttttggggaaacattggaattattattattattattttctagctagcctgaagggctccgattaaggatgaagggaaagtaaacaaaatgattcaatgggtttcatttttctaagtcattcataacctaaatagggatattcctggggtttcaattgtatgtttctgtactaaaccataatactcgcgaaatcttttcccaaaacttcgggttttggagagaggtccccacaaaggcctctaagctctgtaatacatatttaatgtctaaaacaaaaaatctcatttgaagctggggtattagaaagaacatatattctttaaaagaggcatgaaaaaatattttagtgtgtgtactcaaattttatctactgaaatgcatgtagtaggtaggtgaaggaacaagagaaagaaaagaactggatagttcattttctttaaatataaactgtagcaaatgggtttgagatactcctttagtgctccatttgcccttatcccaccacatgcaaagacttgatttggggtagctatatgaagctgaaatctctagccttcaacagtgttctgcagaaggactttgtttcagcccagcaccgttcatcatgcctttaggggtctgggtacccacagctgactttgacctaggactaaaacccagcaatcttttggctcctttctgctttgtttaatgtgtttcaagggcctcgatgcaaggaggcagtgctttaagagtcttcccatttagttcctgcatgcctgtttcgttcccatcaatgtgcgaatggcctagattccaagttatgagggagggtgtgggtcagggttcttacctggtatttaaaaaatgtttgggagtgccctgggcctatttgaaaagtttgaatctgtgatcactgtcagctcctccaagacttctcctctcaacagacaattgcattgtagggcaccccagaccccccttagcctacatggcagcaaataccactgtgccagttatatctggactctagggtagtcttggccaactccaagactggccaactccaagacttgtccactgtgtgcagagtattttaagtatgttatctcatacaatccataaaaacaaccctatagtgttgggtattgctatttcttttatacacatgagaaaatggaggcagtaagaggaagaggaacttgttcaaagtcacacaactgttaggcagaaatgaggtcattcaaatccttaatcttctcctccagaccacactgcctcccaggaagagatgtgggcacctcctgttcttgccaggcaggaaaccgctccttatcaatgtctacggggtctgctctcacacccaggaaggactgtgacaagcatggactaacctgcggctccactcagcctgctgtcagcaccctcctgttcagcaggatgcaacatctgatgttctgccaggaggctgtagagctgcacatagaagtagccagtgtttcttcccattccaaaatggaaatatcactcagccttttttaaaattgacttcctatgttcattttgattgtaggtgatgcagcaagcctcagggctggggattttcaaaatcttgttggctgactattatagatggccttggaatttgctcttgggggtctgaatataacgtaggaaaatgtcctttctcagggagtggggctttaaagttcgtttgtttgtcactccaattttagctgtgcactgcacctttctttgcacccctactctcttcatcttgtctcatagccacagctattgaatttggcctgtgatcataagttgggtttctgatctgatctcttgcattctggtgggtactgggggcagaatcagctttgttaatgattttctgggcagaaggtaaattcagctgcatctgaaggggcttcacagtccaatagccgtccttttgttttacataacagagagtgatggtcaaggccacccacatctttagtggtagagccaggacaaaaagtcaggttttctgcctcttaagtctcatgctgcctcacatagcacctccagagctctagggaaaggaggctcagagagatgaagtgacttgtctgaagtcctgtggctagtggcagagaagttggaattagacctgcattggacctcaattcgctgagcagttgcagggaaatctggaaatccttttttttttttttttgagacagagtcttactctgtcacccaggctggagtgcaatggcgtgatctcagctcactgcaacaccgcctcccgggttcaagcgattctcctgcctcagcctcctgagtagctgggattacagacgcacgccaccatgcccggctaatttttgtatttttagtagagacaaggtttccccatattggtcaggctggtcttgaactcctgaccttgtgatccgcccgccttgacctcccaaagtgctgggatgacaggcgtgatccaccgtgcccagccgggaaatccattttttaaaataaattcaattatgtcttgaatgtactcagaaaacgagctgtttaaaatgtcccattgtgactgtaatgtgaacaatgacctctaacttgtattttatttggcaaggatgggggatgtgcatcaaatcttcacctctgggatttcctgaggcttggtctacttggctcaccctccacctgcatccccaccccactcctagatattaatacaaatctagccttgacaccgcctactgctccaccaccgcctacgtttttggccatcagagccttggagtttacagagcagaggccatgacattggggagcttgtttaaaaatcaatgatcagaaccccacattttagtttccttttggggagaaagaggagggccgtggaagaaaaggggtgtgcagctggagcgttattatgtctttctcagcggcaggcatgcccgcctctccaccttctccccgccaggcacaggagccagcagctggagcgtgctctgagtttcaggggaccccccacccagactgactggggcttctgggacttctcataggaagagtcaagacctcctgcgcttctttaaaaggtgatgggctcagtgttcccagtggcatctggaggtgaagccggtactgtctcaggagtggaaggcaatggcccactggcctttttctcccccacgtcacagtccccatttgctggagcccttgagggggccaccgaaactgtggctctcattcagcctcccaaagtgttgcactactgaatactcctttctgtttacaccagcagtgaatagagtcatgaaaagaacatattatatgcaatggcttgatgcttagtgtggcaatcaaaagcttgcctgggcagatgtaggcaggggctagacaatagtcatggagttgtcaccaggtcactgtctctctccttccccttccaggtctctactgtcccctgcagccaccacaagggctaagctgttgaatgagccccttggtttttccttataaacgcaatgacttacttgtgattcttggtctaatcccaggctaagaaacaaaacaaaagcttgtgatctgacccattcctttgctgccttccttctctttcaggcacctggacgtatttagtattctgccctgtgccttgcccaggggagggagaagtttctagcaaatgtgactttctgtctgctgcctggtgcttttatagtacttcatctgctttttattgttgttgttgtgttttttaaccaaaatggcatttgtttggctgtcattgtcgagtatatatttattgtgttttacaaacatgagtatatatgtatgtatatgtataaaaccaaacttatatatataagaagtcaaggcatgtatactagatattttaaagagttatttatcaagggaaaaagatgtgtgttataaagtaaacagagtctatattttctatataatgtagatagtcaaacatagcttataaattataggaggttttggttttcttttttattattaaaggaaaaaaagaagaaaaaaaaagacaatgaatgcaactgttcttagtgtttttaaggccaaactactgtggaagctgggaggcggccctccctgcgggcctccagcagccctgtgcctgccgctaggagctccagagctgatgcccgttgtgatctctgcgatgctcgatgctcggagccagcggtcagcatcactcagccagctggcctgtgccgctctgacgtggcttccagctgttctccgcaatttgcattggtgggataaaggaatgaaaaggataaataaagatttaaaagaaaatacaa

SEQ ID NO: 884 - DNA, 7147 bp, Homo sapiens
acggtgcctgcacgggacgccgctcgatccccgagccccctcgccgtccccgacagcccccccggcgccatgcaatcccggcttctactcctcggggcacccggaggccacggcggcccggcctcgcggcgcatgcggctgctcctgcggcaggtggtgcagcgcaggccgggtggcgacaggcagcggccggaggtcagactgttgcacgccggctcgggggccgacacaggtgatacagttaatattggagatgtatcctacaagttgaaaattcctaagaatccagaacttgtgccacagaactacatttcagactctctggctcaatctgtagttcagcatctaagatggataatgcagaaggatcttttggggcaagatgtttttctaataggacctcctgggcctcttcgacgctctattgctatgcagtacttggagctgaccaaacgggaggtcgaatacattgccctgtcaagggacaccactgaaactgatctcaaacagcgacgagagatccgtgcaggcacagccttttacattgatcagtgtgcagttcgtgcagccacagaaggcagaactctcattttggaaggtttggaaaaggcagagaggaatgttttgcctgttttgaacaacttgctggaaaacagagagatgcagcttgaagatggacgcttcctgatgtctgctgagcgttacgacaaacttctccgagatcataccaaaaaagagttggattcttggaaaattgtccgagttagtgaaaatttccgagtgattgccttgggcttgccagtgccaaggtattctgggaatccattagacccccctcttcgttctcgatttcaagccagggatatttattatttacccttcaaggaccaacttaagttgttatattcaattggagccaatgtttctgctgagaaagtttctcagctcttgtcctttgccacaactctgtgttcccaagaatcttctactcttggacttccagactttcctttagatagtttagcagctgcggttcaaatcttggattcctttcctatgatgccaatcaaacatgcaatccagtggctttatccatatagtattttactaggtcatgaagggaagatggctgtggaaggtgttttaaagcgctttgaacttcaagattcaggaagctctctacttcctaaagagattgtaaaagtagagaagatgatggaaaaccatgtgtcccaagcttctgtgaccatccggattgcagataaagaggtgaccattaaggtgccagccgggaccaggctattaagtcaaccttgtgcgtcagaccgtttcatacagactttgagccataagcagctacaggctgaaatgatgcagtctcacatggttaaagatatatgtttaattggaggaaagggttgtggaaaaacagtgatcgctaagaactttgccgataccttaggatacaacatagaacctattatgctctatcaggatatgacagcgcgtgatctgctacagcagagatacacccttccaaatggagacactgcctggcggtcctcaccccttgtgaatgctgctctggaaggcaagctggtcctgctggatggcattcaccgggtgaatgcgggcacgcttgctgtattgcaaaggttaatccatgatcgagagctaagcctctatgatggttctaggctgctgagagaagacaggtatatgcgtttaaaggaggagctgcaactgtctgatgaacagctacagaagagatccatttttcctatccatccctccttcagaatcattgccttggcagaaccccctgttattggaagcacagcacaccagtggctgggaccagaattcttaaccatgttctttttccattacatgaaaccacttgtgaaaagtgaagaaatccaagtgattaaggaaaaggtcccaaatgtacctcaggaagctctggataagttattatcatttacacacaaactcagagaaacacaggatccaacggcacaatcattagcggcatcactttctaccagacaactgttgcgaatttctcgtcggctgtcacagtatcctaatgaaaatcttcacagtgctgttactaaagcctgcctttccaggtttttacccagtcttgctaggtcagcattagaaaaaaatctggcagatgctacaatagaaataaatactgatgacaatttggagccagaactgaaggattacaaatgtgaagtaacatctggaactctgaggattggtgctgttagtgcaccgatctataatgcacatgagaaaatgaaagtgcctgatgttcttttctatgacaacattcagcatgtgatagtgatggaagatatgctgaaagactttctccttggagaacacttattattggttggcaaccagggtgtaggaaaaaacaagattgttgacagattccttcacctgctcaacagaccccgagaatatattcagctacacagggataccacagtacaaactcttacgcttcagccttcggttaaagacggacttattgtatatgaagactcacctttggttaaagcagtaaagttgggtcatattctggtagtagatgaggctgacaaagctccaacaaatgtcacgtgtattttaaaaactctagtagaaaatggagaaatgattctagcagatggaagacgcattgttgcaaattctgctaatgtgaatggaagagaaaatgttgtagtgattcatcctgattttaggatgattgttctggcaaatagacctggatttcctttcctaggcaatgatttcttcggtaccttaggtgatatttttagctgccatgcagttgataaccccaaaccccactcggagctcgagatgctcagacagtatggaccaaatgtgcctgagcccatccttcagaagcttgtggctgcctttggagagctgaggagtttggctgaccaagggattattaactatccttattctaccagagaagttgtcaacatagtcaaacatttacagaaatttccgactgaaggtctctccagtgtagttcgaaatgtgtttgactttgattcctacaacaatgacatgagggagatattgattaacactttacacaaatacgggatacctatcggagcaaagcctaccagtgtgcagctggcaaaggagttgactctgccagaacaaacgttcatgggctactggacaattggtcaggcaagaagtgggatgcaaaaactcttgtgtccagtggaaactcatcatatagacataaagggtccagcacttataaatatacaggagtatccaatagaaagacatgaagaaagatccctaaactttactgaagaatgtgcctcatggagaataccattggatgaaattaatataatctgtgacattgctacatcacatgaaaatgagcaaaatactctctatgtagttacatgcaatcccgcttccctgtactttatgaatatgactgggaaaagtggcttctttgtggacttttttgatatcttcccaagaacagccaatggcgtttggcacccttttgtgacagtggcaccgctgggaagtcctctcaaaggtcaagtggttctccatgagcagcagagtaatgttatcctgttgttagatactactggccgggcccttcatcgtctcatcctcccttccgagaagtttacatctaagaaacctttctggtggaacaaagaagaagctgaaacttataaaatgtgtaaagaattttcacacaaaaactggctggtgttctacaaagaaaaagggaacagcctgactgtgctggatgttctagaagggcgaactcacaccatctcacttcccatcaacctcaagacagttttccttgtagcagaggacaaatggcttctggtggagagcaaaacaaatcagaaatatcttttaactaagcctgcacacatcgaatctgagggtagtggggtttgccagttgtatgtgctgaaagaggagccgcccagcacagggtttggagttacacaagaaacagagttcagcatacctcataaaatttccagtgatcaactatcatctgaacatctaagttcagctgtggaacaaaagattgcctctcccaacagaattctctcagatgagaaaaattatgctacaatagttgttggttttccagatctcatgtcacccagtgaagtttattcttggaagagaccatcatctttgcataaacgaagtggcactgatacatcattctatagaggaaagaagaaaagggggactccaaaacaaagcaattgtgtgactcttttagatacgaatcaggtagtgaggattttacccccaggagaagtccctctaaaagatatctacccaaaagatgttactcctccacaaacatctggttatatagaagtcactgatcttcaatcaaagaaactccgatatatccctattcccagatcagaatctctctcgccgtataccacatggctgtcgaccatttcagacacagatgcactgctggctgagtgggacaaaagcggtgttgttactgttgatatgggaggtcacatcaggctttgggaaactggacttgaacgtctgcagcgatcactcatggaatggagaaacatgattggacaagatgacagaaatatgcagataacaatcaacagagacagtggtgaagatgtaagctcccccaaacacgggaaggaggacccagacaacatgcctcacgtgggcggcaacacttgggctggcggaacagggggaagagacacggcaggcctgggtggcaaaggaggcccttaccggctggatgcaggccatacggtgtaccaggtctctcaggctgagaaagatgcagttcccgaagaggtcaagagagctgctagagagatgggccagagagcattccagcagaggctaaaggagatccaaatgagtgaatacgatgctgcaacctatgaaaggttttcaggtgctgttcggcgacaggtgcactccctccgaatcatcctggataatttacaggctaaaggtaaagaaagacaatggctaagacatcaagctactggagaattagatgatgccaagatcattgatgggctgactggagaaaaagccatctacaaacgtcggggtgagctggagccacaacttggcagcccacaacagaaacccaagcgtctgcgcctggtggtagatgtgtctggtagcatgtaccgtttcaacaggatggatggccggcttgagcgcacaatggaggctgtgtgtatggtcatggaagccttcgagaactatgaggagaagttccagtatgacatcgttggacactctggagatggctacaacattggtctggttccaatgaacaaaatccccaaggacaataagcaaagactagaaattctgaagacaatgcatgcccactctcagttctgcatgagtggggaccacacgttagaagggacagaacatgccatcaaggaaattgtcaaagaagaagctgatgagtactttgtcatagtcttgagtgatgcaaatctgtcacgatatggaatacatcctgctaagtttgctcaaatcctcacaagagaccctcaagtaaatgcttttgccatttttattggctctttaggtgatcaagcaaccaggcttcagagaactttaccagctggtcggtctttcgttgccatggataccaaggatatccctcagattttacaacagatcttcacctccaccatgttgtcgagtgtctaagaagtgcccttcatcaccctgatgacaccaggatttgaaataagacaggaataaagagtattctgaaaaaaagaagatatggatgaagtgaacccatgcagtgactggatgattccggcattcctgggtcttcctacacttgctccgtaatgagaattcagagaagcagccagaaggagacttaaacatggaaagatactccactgatgagtttagaagtgattagggcaagctagttgacctgcactttatcaaaggttggggttaaaggaaggtggttttgagaactatgtgtttggtctatttccaaaaacctgagggggagaaaatactttgcttttgccttaacacatcatctggtcacgttagaaaagtgaccccatcaaactgagcctttgatgtcacattctgacacaagatgcaagtctgtgcaaaacccaccaaaatgctcctatccaacaattatttttattttctccctgctctgtattgaccagaaaacaatgattttataatatttaacccaccaaaaagtccctccaacagcaatatcttatgaaagtctggctgttctcaataatttcattttcttggccaaagccaaaaggaatcaaaaaatccttggagtgcttgcctttccacgtgacttttaaaaggctcttaaagagcaaatgtcctcttctccttgctgctagagtgggaggagaaagatgtcttgccttaaaagtttactgtttcttctgttcttctagcatctctcaaaaaattcacagtactccattttggggtccaaactgtaatgctcaaaataataaatgcttacacgaaaattatttattgagaatattcatataaaaattacctaaagcaaagtaaaaaaagtaaaatcaaggtggtatatttgaagtgaatggtgattggaaatttttagctgtaacaaaaagaaagaaaacaactttttttaaagcctcattctcttttctttcaaaatgtaccttattcccacacactcttgggctgacctttattttatcaataagctcaatattactttgtttaaaataagatgcttcagcaaaagtcattctctctttaaccatataatttaaaaactcctcttcacgattgatagcaaaatcagaaacgttagggcaccagtgagttgaaaaaactggtcttaagttggaaaaactattattaataatattatcctatccatccatatctattgaaattgtacaggtccataatttcattttaattaattataggaaagaagaaaagataatacccatttgttctatcacccctctccctatcattaactatcaaataaataaataaaagcaatctgatttcc

SEQ ID NO: 885 - DNA, 852 bp, Homo sapiens
gtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggtcagtatcttacacttatattcgtagaaaaaaaagaatggatttactcttaaagcatggacagataactcttgatatgatataagaatatagtcatttatcagacaattcaggaatagctttatctaagagtaatacatgtaactacacattttccaggttaaaaaaagagagaagagtaatataatcagctgctataataaaaatgcttaaggattttataggacatttcaaaataaggggaaaagttaaatgcaatagatgtgatttctatagcgaaaaccactgaattatatgcttatgataaattgggttaccataatctggaggaaaaaaatctttaaaatatgccattt

SEQ ID NO: 886 - DNA, 1005 bp, Homo sapiens
gggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattaccaca

SEQ ID NO: 887 - DNA, 815 bp, Homo sapiens
agggagctccaacagaactgagggacgaacagtaggtgcctgagagctggccgatctggtcactctctccagtgggccacaggggcccacttggtgggcagtctctgctgccagctagggcatctcagctcagcccagagcaaagacgtgtagggacataacgctttcctcaagcttcctttcccaggtccaaacttagaggcccagttttgggcctagaattcactgaggtttgtggctgtttgtccaacagtcaccatggatcaccgaagccgactacggggcacaggcctgaaccgaatccctgggactcagtcccgagccccccgagtcccactccccttccacgtgcaacaggaggccagggaaggagaagactgggagcgagagccacctcgtcagaggcctcctatctatgagccaccagaaagtgaagagctgccagataatgttatggtttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttag

SEQ ID NO: 888 - DNA, 3275 bp, Homo sapiens
acctgacatgagggcggggaccccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtgatttcatgatcctttggctgcatggagaaaatgggacagggcctgctaagttcaacatacctcacagtgttacacttgattcagctggtcgggtgtgggttgctgaccgaggaaataaaagaatccaagtatttgataaagacactggggagtggttaggagcatggaataattgtttcacagaagagggaccttcttcagtcaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcctgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcactttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacagacttgccctttgaaatctatacctctggatacattagaggcattttattaacaaaggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtcacaaaa

SEQ ID NO: 889 - DNA, 3549 bp, Homo sapiens
ggtggccactgaaagtcagcggcgcggactgccctgagggcgggaaagggtggtcactgggtcagcccgaagcacctgacatgagggcggggaccccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtggattctttggtcatactgttaaaaaatacagttcttttggtgatcttgttcaagtcttgggtactccaggcaaaaaaggcactagtttgaatcctttgcagtttgataacccagcagaattatatgtagaggacacaggagatatttacattgtggatggagatggaggattgaataacagattgatcaaactgtcccaagatttcatgatcctttggctgcatggagaaaatgggacagggcctgctaagttcaacatacctcacagtgttacacttgattcagctggtcgggtgtgggttgctgaccgaggaaataaaagaatccaagtatttgataaagacactggggagtggttaggagcatggaataattgtttcacagaagagggaccttcttcagtcaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcctgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcactttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacagacttgccctttgaaatctatacctctggatacattagaggcattttattaacaaaggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtcacaaaa

SEQ ID NO: 890 - DNA, 2885 bp, Homo sapiens
ccgcgagagagtggagctaactgagcagcgcacccgccacggccgctgccgccccgtgcgcccggctctcccagcaccccgcgcggcgctccagccaggcgcctgtgcgactagcggcggccggcgaagcccgcgccagccccgcgggtcgctgcggcatcctcccgccgcccagcccccgcacgctccctgcagtttaaaaggacctcccgccgcttctcggcgctgccccgggattccccagccccgcgcggctccctactccacttcgcagcaacttcggcgaccgcgcgccgcccgccctcgcccgcctttgaagtttgctgtgccgaccgcaaagttgggacacttcagcggattgaatttttctcttttatctgcctccgtccccgccctccaggcttctcgttcctggatattggtgcttagcatcttggcagggtccggggacgtggactatttcgcacaccacaccacggggagggatttttttctattttccctacgaaaaacagatctttttaaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaagaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagatcattaatgaggaaggcactgagttattctcctacaaaggcaatgatgttgagtattttatatcgtctagttccccatccggtttatatcagttggatcttctttcaacagagaaagacacacatttcaaagtatatgccaccacaactccagaatctgatcagccataccctgagttaccctatgacccaagagtagatgtgacctcactggggcgcaccacggtcactttggcctggaaaccaagccccactgcctctttgctgaaacaacccattcagtactgtgtggtcatcaacaaagagcacaatttcaaaagtctctgtgcagtggaagcaaaactgagtgcagatgatgcttttatgatggcaccgaaacctggtctggacttcagcccctttgactttgcccactttggatttccttctgataattcaggtaaagaacgcagtttccaggcaaagccttctccaaaactggggcgtcatgtctactccaggcccaaggttgatattcagaaaatctgcataggaaacaagaacatcttcaccgtctctgatctgaaacccgacacgcagtactactttgatgtatttgtggtcaacatcaacagcaacatgagcaccgcttatgtaggtacctttgccaggaccaaggaagaagccaaacagaagacagtcgagctaaaagatgggaagataacagatgtatttgttaaaaggaagggagcaaagtttctacggtttgctccagtctcttctcaccaaaaagtcaccttctttattcactcttgtctggatgctgtccaaatccaagtgagaagagatgggaaacttcttctgtctcagaatgtggaaggcattcagcagtttcagcttagaggaaaacctaaagctaaatacctcgttcgactgaaaggaaacaagaaaggagcatctatgttgaaaattctagctaccacaaggcctactaagcagtcatttccctctcttcctgaagacacaagaatcaaagcctttgacaagctccgtacctgttcctcagccaccgtggcttggctaggcactcaggaaaggaacaagttttgcatctacaaaaaagaagtggatgataactacaatgaagaccagaagaaaagagagcaaaaccaatgtctaggaccagatataaggaagaagtcagaaaaggtcctctgtaaatatttccacagtcaaaacctgcagaaagcagtgaccacagaaacaattaaaggtcttcagcctggcaaatcttacctgctggatgtttatgtcataggacatggggggcactctgtaaagtatcagagtaaggttgtgaaaactagaaagttctgttagttaccttcttatagagatatattatgtagaactccaggagggacattaaatcactttaagtataaactgactactcccacagttgagagaagttgtgacctgtacttgtactatggaaggaaggatatcaacgtgtgtatattgatgtttatataagtaactcttgaaggagacttgttctagcgtgccccatggtacctagtgtgtgtctgatgccggttggtgtcaaagatagagggcttcttgaaggaacttgccattccttgctttgaccactgcatgaactgcttctaaattattttattacctaaaaatttaaaatatgccattcattgcacacacccacaaatgcaaatcattcctctctgtagatgctaggatatatataaattattttataaattcttgttttaaatgtcagtgtttctatgattgtaaactattaaattcttttcctattaaagtacagatctaatctaagtattattaagttgatagccctctagtcagttatattgctattgtaaattcttgtttgttgagtaaaatgtttaaatactatatgtatctcatgtacaaagttgacatacattatattcatgtacataaaattaaagagattagattatatactgttcattttcccaagca

SEQ ID NO: 891 - DNA, 1208 bp, Homo sapiens
tccagagaccacatctgcagctcccaaaacaaggtctgttctgcagctggacaattcactgctaaaatcccaaacctaagagcagagccaaagccagaggagaggaaagtgacaatagggccaaagcctcattccagattccaaatgtcattctgtagccctcgtgctatcaactgctgcctgctggctgcagccaggtccctgggtccatacacagcctgcatcaagagcctgcagagactcgggggctggagatgggaaacagatggtggcctgcgctttgtctttcccaagtttacagcctcacctgggggtggaggctgttctgaggggcccccaagaggtcccatacaggcccccaccatgaagggtttcacagccactctcttcctctggactctgatttttcccagctgcagtggaggcggcggtgggaaagcctggcccacacacgtggtctgtagcgacagcggcttggaagtgctctaccagagttgcgatccattacaagattttggcttttctgttgaaaagtgttccaagcaattaaaatcaaatatcaacattagatttggaattattctgagagaggacatcaaagagctttttcttgacctagctctcatgtctcaaggctcatctgttttgaatttctcctatcccatctgtgaggcggctctgcccaagttttctttctgtggaagaaggaaaggagagcagatttactatgctgggcctgtcaataatcctgaatttactattcctcagggagaataccaggttttgctggaactgtacactgaaaaacggtccaccgtggcctgtgccaatgctactatcatgtgctcctgactgtggcctgtagcaaaaatcacagccagctgcatctcgtgggacctccaagctcctctgactgaacctactgtgggaggagaagcagctgatgacagagagaggctctacaaagaagcgcccccaaagagtgcagctgctaattttagtcccaggaccagacatccccagactccacagatgtaatgaagtccccgaatgtatctgtttctaaggagcctcttggcagtccttaagcagtcttgagggtccatcctttttctctaattggtcgcctcccaccagactcacctgcttttcaactttttaggagtgcttcctcacagttaccaagaataaagaaagctggccaccat

SEQ ID NO: 892 - DNA, 4598 bp, Homo sapiens
agctagaagggagcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcattccacggcaaccttcaaatgacttgtttgaaatatttgaaatagaaagaggagtcagtgcagacgatgaagcaaaggatgatccaggtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtgaaattgacttaccctcttcacttaagttagttctggcctgacctgaactctgacttttactgccattcactttataaaataagggtgtgtaacatatcaagatacatttatttttatctgttttttttttcctgttaaagacaattatgtagagtgggcacgtaatccctccttagtagtattgtgttttgtgtaaatgtgctattgatattaagtatttacatgttccaaatatttacagactctagttgcaaggtaaagggcagcttgtgatctcaaaaaaatacatggtgaaatgtcatccagttccatgaccttatattggcagcagtaggaaattggcagaagtgttgggttgtggtaacggagtgatgaatttttttttaatggccttgagtttgatctctgcaaaggataggaaacctttaggaagacaagaaactgcagttaatttagaactgtcactgtttcaagttacactttaaaaccacagcttttaccatcataacatggctctggtaatatgtaggaagctttataaaagttttggttgattcagaaaaaggatcctgttgcagagtgagaggaagcatagggggaaactccattggaacagattttcacacaacgttttaaattgatataagtttaggcagttgtagttcataacttatgttgctcatgttgtgctgtgtcaggatgggataggaagcaagtcccatgcttagaggcatgggatgtgttggaacgggatttacacacactggaggagcagggcaagttggaattctaagatccatgaacccccaactgtatttcctccctgcatattttaccaatatattaaaaaacaatgtaacttttaaaaggcatcattcctgaggtttgtcttaatttctgattaagtaatcagaatattttctgctatttttgccaggaatcacaaagatgattaaagggttggaaaaaaagatctatgatggaaaattaaaggaactgggattattgagcctggagaagagaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcctactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatggcaatcctagcagtattaaagaaaaaaggaaactatttattccaaatgagagtatgatggacagatattttagtatctcagtaatgtcctagtgtggcggtggttttcaatgtttcttcatgttaaaggtataagcctttcatttgttcaatggatgatgtttcagatttttttttttttaagagatccttcaaggaacacagttcagagagattttcatcgggtgcattctctctgcttcgtgtgtgacaagttatcttggctgctgagaaagagtgccctgccccacaccggcagacctttccttcacctcatcagtatgattcagtttctcttatcaattggactctcccaggttccacagaacagtaatattttttgaacaataggtacaatagaaggtcttctgtcatttaacctggtaaaggcagggctggagggggaaaataaatcattaagcctttgagtaacggcagaatatatggctgtagatccatttttaatggttcatttcctttatggtcatataactgcacagctgaagatgaaaggggaaaataaatgaaaattttacttttcgatgccaatgatacattgcactaaactgatggaagaagttatccaaagtactgtataacatcttgtttattatttaatgttttctaaaataaaaaatgttagtggttttccaaatggcctaataaaaacaattatttgtaaataaaaacactgttagtaatacca

SEQ ID NO: 893 - DNA, 4244 bp, Homo sapiens
ggagacgggatcatgaagcgctcggtagccgtctggctcttggtcgggctcagcctcggtgtcccccagttcggcaaaggtgatatttgtgatcccaatccatgtgaaaatggaggtatctgtttgccaggattggctgatggttccttttcctgtgagtgtccagatggcttcacagaccccaactgttctagtgttgtggaggttggtccctgcactcctaatccatgccataatggaggaacctgtgaaataagtgaagcataccgaggggatacattcataggctatgtttgtaaatgtccccgaggatttaatgggattcactgtcagcacaacataaatgaatgcgaagttgagccttgcaaaaatggtggaatatgtacagatcttgttgctaactattcctgtgagtgcccaggcgaatttatgggaagaaattgtcaatacaaatgctcaggcccactgggaattgaaggtggaattatatcaaaccagcaaatcacagcttcctctactcaccgagctctttttggactccaaaaatggtatccctactatgcacgtcttaataagaaggggcttataaatgcgtggacagctgcagaaaatgacagatggccgtggattcagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagtttggccaagcatactcatcatttctttgttcagctccacatttcctgtgaaactaacatcttattgagatttgaaactggtggtagtttcccaggaaggcacaggtggagttatttgtgagaagcaaagtgtttactaatgacaaagtagtaaaccattttcaagatgaaaactgatttctatttattttgcttcaaaggtcctgaaaaaataagcaattatcataacaatttgttattgatactggaggtttcattgacatgtctctcaaattaaagctcacactgcctccataaaagtcttcaacatctaatttataagctttacaagtatttattttataaggcttagacagaattattggagttttaaattaagtgtattggaaaagaaaggatggtatgtgtatgaaatgttaagatcctacgcaacactgctatttttttcctttaatatttgtgctgcataacaaaagccactagactgttactgtcttgtctgtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttacgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagc

SEQ ID NO: 894 - DNA, 1333 bp, Homo sapiens
tctgggtcacatttttgtggatacagaagccaggctggagtggaccagtgagtgagttggagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctag

SEQ ID NO: 895 - DNA, 714 bp, Homo sapiens
gatccaccctgtgatctgtcacttttatatacacacaggggaggggaccgtttccatagagagggaatatcacagcccacttaggaacaataccggagaagcaggagccgagaccccggagcagccacaagttcatggggacgtgcacggggccgccctcctggccctgaagctgcgccggcctccctgagcgtttcgctgcggagggaagtccactctcggggagagatgctgatgccggtccacttcctgctgctcctgctgctgctcctggggggccccaggacaggcctcccccacaagttctacaaagccaagcccatcttcagctgcctcaacaccgccctgtctgaggctgagaagggccagtgggaggatgcatccctgctgagcaagaggagcttccactacctgcgcagcagagacgcctcttcgggagaggaggaggagggcaaagagaaaaagactttccccatctctggggccaggggtggagccagaggcacccggtacagatacgtgtcccaagcacagcccaggggaaagccacgccaggacacggccaagagtccccaccgcaccaagttcaccctgtccctcgacgtccccaccaacatcatgaacctcctcttcaacatcgccaaggccaagaacctgcgtgcccaggcggccgccaatgcccacctgatggcgcaaattgggaggaagaagtag

SEQ ID NO: 896 - DNA, 6345 bp, Homo sapiens
gctcgcgcccctgttccgcaggtgtgcggggcttgcgcccagcccgggccgcggccgccgcgcgtttcctccccgcttgcccgcccagaggcccccggccacgctcctcgccgggctccgaccccgccgcgccccctccacgcccccagcgcgctgtggccgcagccagcgcgtgtcctgagtccgccgttccggcccggggctgccggggaagttggggcgaggcgggccggggatgcgccatggccatggcccggctgggctcgtggctcggggaggcgcagtggctcgcgctggtgtcgctcttcgtcgcggccctggccacggtaggcctgtacctggcgcagtgggcgctggccagggcgcgaccccagccccagcggcgggcggtggagcctggagaggggccgcgcccggggtccgacgcgctgctctcctggatcctgacgctgggcagctggaggagccagtggcaggcggcctgggtgaccgccctgaacgaggaggccgagaggaaagggggcccacctttcctgtcctttgaggaggacccgcggcagcaggcactggagctggtggtgcaggaggtctccagcgtgctcaggtcggcggaggagaaggtggtggtctgtcacgtggtgggccaggctattcagttcttggtcagcgagacgcctgccttgggtgctggatgccggctgtacgacatgcggctctcccctttccatttacagctggagttccacatgaaggagaagagagaggacctccagattagctggtctttcatcagtgtgccggaaatggccgttaatatccagcccaaagcactgggggaggaccaggtggctgagacaagtgcgatgtctgacgttctcaaggacatcttgaagcatttggctggttctgcctctccatcagtggttctgattaccaagcccacgactgtaaaggaagctcagaacttacagtgtgctgcatctactgctcaggaatcctgtcctcctaaacctccaagggctcacgagctgaagctactggtgaggaacatccacgtcttgctgctcagcgagcccggtgcctcaggccacattaatgcagtgtgcgtcgtgcagctgaacgatcctgttcagaggttctccagcaccctgacgaaaaacactccggacctcatgtgggaagaggaattcaccttcgagttgaatgccaagtcgaaggagttacacctgcagatttcagaggctgggcgatcctcagaaggtctgctggcgacggcgacagttcctctggacttatttaagaagcagccttctgggccacagagcttcacgctgaccagcgggtctgcctgcggcagctcggtgctgggctcggtcacggcagagttctcttacatggaacctggtgaattgaaatcctggcccatccctccccctgttcctgctgcaaaaatagaaaaggaccgcacggtgatgccctgtgggactgtggtcactactgtcactgctgtgaagaccaagcctcgcgtcgacgtggggagggcgtccccgctgagctctgattctccggtgaagactcccatcaaggtgaaggtgatcgagaaggacatctctgtccaggccatcgcctgccgcagcgcccccgtcagcaaaacactctcttcttcagacacagaattgttggtgttgaatggttcggatccagtggctgaagtggccattcgacagctcagtgaatcttcaaagctgaaactcaagtcgccacggaagaaaagcactattatcatatcagggatctccaagacctcactatctcaggaccacgacgctgccctgatgcagggctacacggcctctgtggacagcacccaccaggaggacgccccatcccatccggagagggcggcagcctctgccccgccagaggaagccgagtcagcccaggcatcccttgcccccaagccccaggaggacgagctagactcctgggacttggagaaggagccacaggccgcggcatggagcagccaggtcctgctggaccccgacggtgatgagctgtcagagagctccatgagtgtcttggagccgggcactgccaaaaagcataaaggaggaattctaaggaaaggtgcaaagctgttcttccgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaaccggtatcaaaaccaaaattataggatttttttcttttttagtaaaaacctatataaaaaccaaaattataggattttttcttttttagtaaaaacctatatgaaaaccaaaattataggatttttttcttttttagtaaaaacctgtataaaaaccaaaattataggatttttttttcttcttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgttagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaggttttaactattccatttccagatgaatcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgaaaacctgctgtgagagttttgacagagcactttattttcgtcaagtttcaagtctgagttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaagtggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaacacta

SEQ ID NO: 897 - DNA, 1184 bp, Homo sapiens
agccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatga

SEQ ID NO: 898 - DNA, 2391 bp, Homo sapiens
tcggcaggaagagaccgacccgccacccgccgtagcccgcgcgcccctggcactcaatccccgccatgtgggggctcctgctcgccctggccgccttcgcgccggccgtcggcccggctctgggggcgcccaggaactcggtgctgggcctcgcgcagcccgggaccaccaaggtcccaggctcgaccccggccctgcatagcagcccggcacagccgccggcggagacagctaacgggacctcagaacagcatgtccggattcgagtcatcaagaagaaaaaggtcattatgaagaagcggaagaagctaactctaactcgccccaccccactggtgactgccgggccccttgtgacccccactccagcagggaccctcgaccccgctgagaaacaagaaacaggctgtcctcctttgggtctggagtccctgcgagtttcagatagccggcttgaggcatccagcagccagtcctttggtcttggaccacaccgaggacggctcaacattcagtcaggcctggaggacggcgatctatatgatggagcctggtgtgctgaggagcaggacgccgatccatggtttcaggtggacgctgggcaccccacccgcttctcgggtgttatcacacagggcaggaactctgtctggaggtatgactgggtcacatcatacaaggtccagttcagcaatgacagtcggacctggtggggaagtaggaaccacagcagtgggatggacgcagtatttcctgccaattcagacccagaaactccagtgctgaacctcctgccggagccccaggtggcccgcttcattcgcctgctgccccagacctggctccagggaggcgcgccttgcctccgggcagagatcctggcctgcccagtctcagaccccaatgacctattccttgaggcccctgcgtcgggatcctctgaccctctagactttcagcatcacaattacaaggccatgaggaagctgatgaagcaggtacaagagcaatgccccaacatcacccgcatctacagcattgggaagagctaccagggcctgaagctgtatgtgatggaaatgtcggacaagcctggggagcatgagctgggggagcctgaggtgcgctacgtggctggcatgcatgggaacgaggccctggggcgggagttgcttctgctcctgatgcagttcctgtgccatgagttcctgcgagggaacccacgggtgacccggctgctctctgagatgcgcattcacctgctgccctccatgaaccctgatggctatgagatcgcctaccaccggggttcagagctggtgggctgggccgagggccgctggaacaaccagagcatcgatcttaaccataattttgctgacctcaacacaccactgtgggaagcacaggacgatgggaaggtgccccacatcgtccccaaccatcacctgccattgcccacttactacaccctgcccaatgccaccgtggctcctgaaacgcgggcagtaatcaagtggatgaagcggatcccctttgtgctaagtgccaacctccacgggggtgagctcgtggtgtcctacccattcgacatgactcgcaccccgtgggctgcccgcgagctcacgcccacaccagatgatgctgtgtttcgctggctcagcactgtctatgctggcagtaatctggccatgcaggacaccagccgccgaccctgccacagccaggacttctccgtgcacggcaacatcatcaacggggctgactggcacacggtccccgggagcatgaatgacttcagctacctacacaccaactgctttgaggtcactgtggagctgtcctgtgacaagttccctcacgagaatgaattgccccaggagtgggagaacaacaaagacgccctcctcacctacctggagcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattgatacctgcggtttaagagccctagggcaggctggacctgtcaagacgggaaggggaagagtagagagggagggacaaagtgaggaaaaggtgctcattaaagctaccgggcaccttagctca

SEQ ID NO: 899 - DNA, 1239 bp, Homo sapiens
agacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccagtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacagat

SEQ ID NO: 900 - DNA, 9765 bp, Homo sapiens
gagctgcctcacccccggccccgggaagggcatggccccggcaaactcccggccgtgactcgcgcgccccggctcggtggatgctcccggcgcaccgctcccgtgtgcggcggcttcccaaggacagatgcccaagcgcgcgcactggggggccctctccgtggtgctgatcctgctttggggccatccgcgagtggcgctggcctgcccgcatccttgtgcctgctacgtccccagcgaggtccactgcacgttccgatccctggcttccgtgcccgctggcattgctaaacacgtggaaagaatcaatttggggtttaatagcatacaggccctgtcagaaacctcatttgcaggactgaccaagttggagctacttatgattcacggcaatgagatcccaagcatccccgatggagctttaagagacctcagctctcttcaggttttcaagttcagctacaacaagctgagagtgatcacaggacagaccctccagggtctctctaacttaatgaggctgcacattgaccacaacaagatcgagtttatccaccctcaagctttcaacggcttaacgtctctgaggctactccatttggaaggaaatctcctccaccagctgcaccccagcaccttctccacgttcacatttttggattatttcagactctccaccataaggcacctctacttagcagagaacatggttagaactcttcctgccagcatgcttcggaacatgccgcttctggagaatctttacttgcagggaaatccgtggacctgcgattgtgagatgagatggtttttggaatgggatgcaaaatccagaggaattctgaagtgtaaaaaggacaaagcttatgaaggcggtcagttgtgtgcaatgtgcttcagtccaaagaagttgtacaaacatgagatacacaagctgaaggacatgacttgtctgaagccttcaatagagtcccctctgagacagaacaggagcaggagtattgaggaggagcaagaacaggaagaggatggtggcagccagctcatcctggagaaattccaactgccccagtggagcatctctttgaatatgaccgacgagcacgggaacatggtgaacttggtctgtgacatcaagaaaccaatggatgtgtacaagattcacttgaaccaaacggatcctccagatattgacataaatgcaacagttgccttggactttgagtgtccaatgacccgagaaaactatgaaaagctatggaaattgatagcatactacagtgaagttcccgtgaagctacacagagagctcatgctcagcaaagaccccagagtcagctaccagtacaggcaggatgctgatgaggaagctctttactacacaggtgtgagagcccagattcttgcagaaccagaatgggtcatgcagccatccatagatatccagctgaaccgacgtcagagtacggccaagaaggtgctactttcctactacacccagtattctcaaacaatatccaccaaagatacaaggcaggctcggggcagaagctgggtaatgattgagcctagtggagctgtgcaaagagatcagactgtcctggaagggggtccatgccagttgagctgcaacgtgaaagcttctgagagtccatctatcttctgggtgcttccagatggctccatcctgaaagcgcccatggatgacccagacagcaagttctccattctcagcagtggctggctgaggatcaagtccatggagccatctgactcaggcttgtaccagtgcattgctcaagtgagggatgaaatggaccgcatggtatatagggtacttgtgcagtctccctccactcagccagccgagaaagacacagtgacaattggcaagaacccaggggagtcggtgacattgccttgcaatgctttagcaatacccgaagcccaccttagctggattcttccaaacagaaggataattaatgatttggctaacacatcacatgtatacatgttgccaaatggaactctttccatcccaaaggtccaagtcagtgacagtggttactacagatgtgtggctgtcaaccagcaaggggcagaccattttacggtgggaatcacagtgaccaagaaagggtctggcttgccatccaaaagaggcagacgcccaggtgcaaaggctctttccagagtcagagaagacatcgtggaggatgaagggggctcgggcatgggagatgaagagaacacttcaaggagacttctgcatccaaaggaccaagaggtgttcctcaaaacaaaggatgatgccatcaatggagacaagaaagccaagaaagggagaagaaagctgaaactctggaagcattcggaaaaagaaccagagaccaatgttgcagaaggtcgcagagtgtttgaatctagacgaaggataaacatggcaaacaaacagattaatccggagcgctgggctgatattttagccaaagtccgtgggaaaaatctccctaagggcacagaagtacccccattgattaaaaccacaagtcctccatccttgagtctagaagtcacaccaccttttcctgctatttctcccccctcagcatctcctgtgcagacagtaaccagtgctgaagaatcctcagcagatgtacctctacttggtgaagaagagcacgttttgggtaccatttcctcagccagcatggggctagaacacaaccacaatggagttattcttgttgaacctgaagtaacaagcacacctctggaggaagttgttgatgacctttccgagaagactgaggagataacttccactgaaggagacctgaaggggacagcagcccctacacttatatctgagccttatgaaccatctcctactctgcacacattagacacagtctatgaaaagcccacccatgaagagacggcaacagagggttggtctgcagcagatgttggatcgtcaccagagcccacatccagtgagtatgagcctccattggatgctgtctccttggctgagtctgagcccatgcaatactttgacccagatttggagactaagtcacaaccagatgaggataagatgaaagaagacacctttgcacaccttactccaacccccaccatctgggttaatgactccagtacatcacagttatttgaggattctactataggggaaccaggtgtcccaggccaatcacatctacaaggactgacagacaacatccaccttgtgaaaagtagtctaagcactcaagacaccttactgattaaaaagggtatgaaagagatgtctcagacactacagggaggaaatatgctagagggagaccccacacactccagaagttctgagagtgagggccaagagagcaaatccatcactttgcctgactccacactgggtataatgagcagtatgtctccagttaagaagcctgcggaaaccacagttggtaccctcctagacaaagacaccacaacagcaacaacaacaccaaggcaaaaagttgctccgtcatccaccatgagcactcacccttctcgaaggagacccaacgggagaaggagattacgccccaacaaattccgccaccggcacaagcaaaccccacccacaacttttgccccatcagagactttttctactcaaccaactcaagcacctgacattaagatttcaagtcaagtggagagttctctggttcctacagcttgggtggataacacagttaatacccccaaacagttggaaatggagaagaatgcagaacccacatccaagggaacaccacggagaaaacacgggaagaggccaaacaaacatcgatataccccttctacagtgagctcaagagcgtccggatccaagcccagcccttctccagaaaataaacatagaaacattgttactcccagttcagaaactatacttttgcctagaactgtttctctgaaaactgagggcccttatgattccttagattacatgacaaccaccagaaaaatatattcatcttaccctaaagtccaagagacacttccagtcacatataaacccacatcagatggaaaagaaattaaggatgatgttgccacaaatgttgacaaacataaaagtgacattttagtcactggtgaatcaattactaatgccataccaacttctcgctccttggtctccactatgggagaatttaaggaagaatcctctcctgtaggctttccaggaactccaacctggaatccctcaaggacggcccagcctgggaggctacagacaggcatacctgttaccacttctggggaaaatcttacagaccctccccttcttaaagagcttgaggatgtggatttcacttccgagtttttgtcctctttgacagtctccacaccatttcaccaggaagaagctggttcttccacaactctctcaagcataaaagtggaggtggcttcaagtcaggcagaaaccaccacccttgatcaagatcatcttgaaaccactgtggctattctcctttctgaaactagaccacagaatcacacccctactgctgcccggatgaaggagccagcatcctcgtccccatccacaattctcatgtctttgggacaaaccaccaccactaagccagcacttcccagtccaagaatatctcaagcatctagagattccaaggaaaatgttttcttgaattatgtggggaatccagaaacagaagcaaccccagtgaacaatgaaggaacacagcatatgtcagggccaaatgaattatcaacaccctcttccgaccaggatgcatttaacttgtctacaaagctggaattggaaaagcaagtatttggtagtaggagtctaccacgtggcccagatagccaacgccaggatggaagagttcatgcttctcatcaactaaccagagtccctgccaaacccatcctaccaacagcaacagtgaggctgcctgaaatgtccacacaaagcgcttccagatactttgtaacttcccagtcacctcgtcactggaccaacaaaccggaaataactacatatccttctggggctttgccagagaacaaacagtttacaactccaagattatcaagtacaacaattcctctcccattgcacatgtccaaacccagcattcctagtaagtttactgaccgaagaactgaccaattcaatggctactccaaagtgtttggaaataacaacatccctgaggcaagaaacccagttggaaagcctcccagtccaagaattcctcattattccaatggaagactccctttctttaccaacaagactctttcttttccacagttgggagtcacccggagaccccagatacccacttctcctgccccagtaatgagagagagaaaagttattccaggttcctacaacaggatacattcccatagcaccttccatctggactttggccctccggcacctccgttgttgcacactccgcagaccacgggatcaccctcaactaacttacagaatatccctatggtctcttccacccagagttctatctcctttataacatcttctgtccagtcctcaggaagcttccaccagagcagctcaaagttctttgcaggaggacctcctgcatccaaattctggtctcttggggaaaagccacaaatcctcaccaagtccccacagactgtgtccgtcaccgctgagacagacactgtgttcccctgtgaggcaacaggaaaaccaaagcctttcgttacttggacaaaggtttccacaggagctcttatgactccgaataccaggatacaacggtttgaggttctcaagaacggtaccttagtgatacggaaggttcaagtacaagatcgaggccagtatatgtgcaccgccagcaacctgcacggcctggacaggatggtggtcttgctttcggtcaccgtgcagcaacctcaaatcctagcctcccactaccaggacgtcactgtctacctgggagacaccattgcaatggagtgtctggccaaagggaccccagccccccaaatttcctggatcttccctgacaggagggtgtggcaaactgtgtcccccgtggagggccgcatcaccctgcacgaaaaccggaccctttccatcaaggaggcgtccttctcagacagaggcgtctataagtgcgtggccagcaatgcagccggggcggacagcctggccatccgcctgcacgtggcggcactgccccccgttatccaccaggagaagctggagaacatctcgctgcccccggggctcagcattcacattcactgcactgccaaggctgcgcccctgcccagcgtgcgctgggtgctcggggacggtacccagatccgcccctcgcagttcctccacgggaacttgtttgttttccccaacgggacgctctacatccgcaacctcgcgcccaaggacagcgggcgctatgagtgcgtggccgccaacctggtaggctccgcgcgcaggacggtgcagctgaacgtgcagcgtgcagcagccaacgcgcgcatcacgggcacctccccgcggaggacggacgtcaggtacggaggaaccctcaagctggactgcagcgcctcgggggacccctggccgcgcatcctctggaggctgccgtccaagaggatgatcgacgcgctcttcagttttgatagcagaatcaaggtgtttgccaatgggaccctggtggtgaaatcagtgacggacaaagatgccggagattacctgtgcgtagctcgaaataaggttggtgatgactacgtggtgctcaaagtggatgtggtgatgaaaccggccaagattgaacacaaggaggagaacgaccacaaagtcttctacgggggtgacctgaaagtggactgtgtggccaccgggcttcccaatcccgagatctcctggagcctcccagacgggagtctggtgaactccttcatgcagtcggatgacagcggtggacgcaccaagcgctatgtcgtcttcaacaatgggacactctactttaacgaagtggggatgagggaggaaggagactacacctgctttgctgaaaatcaggtcgggaaggacgagatgagagtcagagtcaaggtggtgacagcgcccgccaccatccggaacaagacttacttggcggttcaggtgccctatggagacgtggtcactgtagcctgtgaggccaaaggagaacccatgcccaaggtgacttggttgtccccaaccaacaaggtgatccccacctcctctgagaagtatcagatataccaagatggcactctccttattcagaaagcccagcgttctgacagcggcaactacacctgcttggtcaggaacagcgcgggagaggataggaagacggtgtggattcacgtcaacgtccagccacccaagatcaacggtaaccccaaccccatcaccactgtgcgggagatagcagccgggggcagtcggaaactgattgactgcaaagctgaaggcatccccaccccgagggtgttatgggcttttcccgagggtgtggttctgccagctccatactatggaaaccggatcactgtccatggcaacggttccctggacatcaggagtttgaggaagagcgactccgtccagctggtatgcatggcacgcaacgagggaggggaggccaggttgatcctgcagctcactgtcctggagcccatggagaaacccatcttccacgacccgatcagcgagaagatcacggccatggcgggccacaccatcagcctcaactgctctgccgcggggaccccgacacccagcctggtgtgggtccttcccaatggcaccgatctgcagagtggacagcagctgcagcgcttctaccacaaggctgacggcatgctacacattagcggtctctcctcggtggacgccggggcctaccgctgcgtggcccgcaatgccgctggccacacggagaggctggtctccctgaaggtgggactgaagccagaagcaaacaagcagtatcataacctggtcagcatcatcaatggtgagaccctgaagctcccctgcacccctcccggggctgggcagggacgtttctcctggacgctccccaatggcatgcatctggagggcccccaaaccctgggacgcgtttctcttctggacaatggcaccctcacggttcgtgaggcctcggtgtttgacaggggtacctatgtatgcaggatggagacggagtacggcccttcggtcaccagcatccccgtgattgtgatcgcctatcctccccggatcaccagcgagcccaccccggtcatctacacccggcccgggaacaccgtgaaactgaactgcatggctatggggattcccaaagctgacatcacgtgggagttaccggataagtcgcatctgaaggcaggggttcaggctcgtctgtatggaaacagatttcttcacccccagggatcactgaccatccagcatgccacacagagagatgccggcttctacaagtgcatggcaaaaaacattctcggcagtgactccaaaacaacttacatccacgtcttctgaaatgtggattccagaatgattgcttaggaactgacaacaaagcggggtttgtaagggaagccaggttggggaataggagctcttaaataatgtgtcacagtgcatggtggcctctggtgggtttcaagttgaggttgatcttgatctacaattgttgggaaaaggaagcaatgcagacacgagaaggagggctcagccttgctgagacactttcttttgtgtttacatcatgccaggggcttcattcagggtgtctgtgctctgactgcaatttttctttttttgcaaatgccactcgactgccttcataagcgtccataggatatctgaggaacattcatcaaaaataagccatagacatgaacaacacctcactaccccattgaagacgcatcacctagttaacctgctgcagtttttacatgatagactttgttccagattgacaagtcatctttcagttatttcctctgtcacttcaaaactccagcttgcccaataaggatttagaaccagagtgactgatatatatatatattttaattcagagttacatacatacagctaccattttatatgaaaaaagaaaaacatttcttcctggaactcactttttatataatgttttatatatatattttttcctttcaaatcagacgatgagactagaaggagaaatactttctgtcttattaaaattaataaattattggtctttacaagacttggatacattacagcagacatggaaatataattttaaaaaatttctctccaacctccttcaaattcagtcaccactgttatattaccttctccaggaaccctccagtggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcagtatctggcttgtccatctggtctaaggtggctgcttcttccccagccatgagtcagtttgtgcccatgaataatacacgacctgttatttccatgactgctttactgtatttttaaggtcaatatactgtacatttgataataaaataatattctcccaaaaa

SEQ ID NO: 901 - DNA, 5508 bp, Homo sapiens
gcgttccttgcggcccggccgacctcgcgggcttgggcctgggcgggcaccgacggagcggccctggctgcagcctcccggcgccagcgaagacaggctgagatgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgaggctacaaccagatcctcatagttcccatgggtgccaccagcatcctcatcgacgaggctgctgccagcaggaacttcctggctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgcctaccccgtgcggtgcctgctgcccagtgcccatggctcttgcgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagacagagtttcactcttgttgcccaggctggagggcaatggcgcgatctcagctcactgcaacctccgtctcctgggttcttgattctcctgtgtcagccttctgagtagctaggattacagatgcctatcaccatgcctgggtaatttttgtatttttagttgagatggggtttcaccatgttggccaggctggtctcgaacttctgacctcagatgatctgcccgcctcagcctcccaaagtgctgggattacaggcatgagccaccacgcccagccatcaatgcattttttttattttttttttgagacagagtttcgcacttcttgcccaggctggagtacaatggtgcgatcttggctcactgcaacctccacctcctgggttcaagcgcttctccagcctcagcctcctgagtagctgggattacaggtatgtgccaccatgcctggctaattttgtatttttagtagagacggggtttctccatgttggtcagactggtcttgaactcccgacctcaggtaatccgcccgcctcggcctcccaaaatgctgggattagaggtgtgagccactgtgcccagcccatcaatgtgttttaaagctagctgtcagggttccacttaatttaaagctgggcagggagatgtgtaatgatttcaaagttaacacctgtttgttttctaaagggcatgccaagtcctgctgtatcagggaagtattctgtgctaaaatcagcgatggttcattgctctagtctctctcacccttctaggcagtgcatcagtcagctctaaatctggtgcagagggttaacagcataacccttgttggcaaaatggaatagatgttaagacctcaaatagggatttgggatgaaacagctgcagttagcactgttatctgagcatgaaagaactggaaacgctccttacgtcgagatgttggaccttgaagccctcctgaggccaacatgcaaatctggctgtgacggttcatctgacacctgtgtaaagctgaccagcctgctctgtacagtgacaatgaggagcccctctcttccttaagtaggaatctgtgaagcaaaatgtttgctgccaaagacaaatcagactgtcagtcattaaaaacagcattagcaggatgaggatagcaatggggaagggttgtgggcaatgcagtaacagggaaatggcttcagaaatggtttgagttggaagacaacattcttcatctctcaggacttctaattccttgatgctaaaagaagaggcatggattctatgagcttccaagtccctttccactttaaccttctacaaatctttcagaggactgcctagtagcaaaggttattcctggacacaggaaagacgggcattacagggaccaaagctctgaaaggtgacttttattaccaacacactggctggaaaagggacaaaccacatcacgggtgagtgatacttctcagtcttctctactcattcaacaaaggaaatgtgggctggggcagaggtcttttttcatttaatactggaaaaatattgaagagcatccatgttcacttatggctggttttgctatagaaattggaaaataaaggccacttttttgaaatccccagtttaatt

SEQ ID NO: 902 - DNA, 1326 bp, Homo sapiens
agctaccagtttggacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggaggatccttttggtgaagagtttggtatctgcaaagagcatgacatggcatctggagatggcaatattgtgagagaagaagttgtgaaagagaatgctgccgggtctcccgtaatgaggaaatggttaaatccacgctgatcccggctgtgatttctgagagaaggctctattttcgtgattgttcaacacacagccaacattttaggaactttctagattatagcataaggacatgtaatttttgaagaccaaatgtgatgcatggtggatccagaaaacaaaaagtaggatacttacaatccataacatccatatgactgaacacttgtatgtgtttgttaaatattcgaatgcatgtagatttgttaaatgtgtgtgtatagtaacactgaagaactaaaaatgcaatttaggtaatcttacgtggagacaggtcaaccaaagagggagctaggcaaagctgaagaccgcagtgagtcaaattagttctttgactttgatgtacattaatgttgggatatggaatgaagacttaagagcaggagaagatggggagggggtgggagtgggaaataaaatatttagcccttccttggtaggtagcttctctagaatttaattgtgcttttttttttttttttggctttgggaaaagtcaaaataaaacaaccagaaaacccctgaaggaagtaagatgtttgaagcttatggaaatttgagtaacaaacagctttgaactgagagcaatttcaaaaggctgctgatgtagttcccgggttacctgtatctgaaggacggttctggggcataggaaacacatacacttccataaatagctttaacgtatgccacctcagagataaatctaagaagtattttacccactggtggtttgtgtgtgtatgaaggtaaatatttatatatttttataaataaatgtgttagtgcaagtcatcttccctacccatatttatcatcctctt

SEQ ID NO: 903 - DNA, 2169 bp, Homo sapiens
ggaaattgatgacgggaaagcatgcgggcaacccagtgtataaaactcataaacgtgtaggcagaggctcagctaccagtttggacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggaggatccttttggtgaagagtttggtatctgcaaagactgtccctacggcaccttcgggatggattgcagagagacctgcaactgccagtcaggcatctgtgacagggggacgggaaaatgcctgaaattccccttcttccaatattcagtaaccaagtcttccaacagatttgtttctctcacggagcatgacatggcatctggagatggcaatattgtgagagaagaagttgtgaaagagaatgctgccgggtctcccgtaatgaggaaatggttaaatccacgctgatcccggctgtgatttctgagagaaggctctattttcgtgattgttcaacacacagccaacattttaggaactttctagattatagcataaggacatgtaatttttgaagaccaaatgtgatgcatggtggatccagaaaacaaaaagtaggatacttacaatccataacatccatatgactgaacacttgtatgtgtttgttaaatattcgaatgcatgtagatttgttaaatgtgtgtgtatagtaacactgaagaactaaaaatgcaatttaggtaatcttacgtggagacaggtcaaccaaagagggagctaggcaaagctgaagaccgcagtgagtcaaattagttctttgactttgatgtacattaatgttgggatatggaatgaagacttaagagcaggagaagatggggagggggtgggagtgggaaataaaatatttagcccttccttggtaggtagcttctctagaatttaattgtgcttttttttttttttttggctttgggaaaagtcaaaataaaacaaccagaaaacccctgaaggaagtaagatgtttgaagcttatggaaatttgagtaacaaacagctttgaactgagagcaatttcaaaaggctgctgatgtagttcccgggttacctgtatctgaaggacggttctggggcataggaaacacatacacttccataaatagctttaacgtatgccacctcagagataaatctaagaagtattttacccactggtggtttgtgtgtgtatgaaggtaaatatttatatatttttataaataaatgtgttagtgcaagtcatcttccctacccatatttatcatcctcttgaggaaagaaatctagtattatttgttgaaaatggttagaataaaactatgactctataaggttttcaaacatctgaggcatgataaatttattatccataattatagtaataataaccttaataagcataagaaaaacagagtcactctggatttcaaaaatgtcaaaaaatgagcaacagagggtccttatttaaacataagtgctgtgacttaggtgaattttcaatttaaggtagaaaataagtttttaggaggtttgtaaaagaagaatcaattttcagcagaaaacatgtcaactttaaaatatagtttattttcatatttttttcttttaaacttggttgataagtggaattaggagtatatttgaaagaatcttagcacaaacaggactgttgtactagatgttcttaggaaatatctcagaagtattttatttgaagtgaagaacttatttaagaattatttcagtatttacctgtattttattcttgaagttggccaacagagttgtgaatgtgtgtgggaaggcctttgaatgtaaagctgcataagctgttaggttttgttttaaaaggacatgtttattattgttcaataaaaaagaacaagatacagct

SEQ ID NO: 904 - DNA, 823 bp, Homo sapiens
gggcatctccaggacaggcattcaggcagagcaagctccaggtttcaccacaatgcccatccctgcctccccactccacccacctctgccttccttactgctgtatctgctgcttgaactggcaggagtcacacatgtgttccatgtgcaacaaacggagatgtcacagactgtatcaactggggagtcaatcatcttgagttgcagcgtacccaataccttaccaaatggacctgtcttgtggttcaagggaacagggccaaaccggaaattaatctacaatttcaaacaaggtaactttcccagagtaaaagagattggagacaccaccaagcctggcaacacagacttttccacccgcatccgtgaaatctctcttgctgatgctggcacctattactgcgtgaagttcataaaaggaagagctatcaaggagtaccaatcaggtcggggcactcaggtgtttgttactgcagagcagaatccaagacctcccaagaacagacctgcaggcagagcaggctccagggcccaccatgatgcccatacctgcctctcggccctgcctgagagaaacagcacaaactatttcgtccaaccctgctgctgcctccggctgctgggactcacaggcttgctgtcaaaataatccaaacagggaaggaacgtacaagtaaataacaaaagcccccatactcttctgactccctggagacagctactttttaggagtttcatttgccttcttcaagagagctttcttccactgacataaaatgccagcttgatcgtacaataaatctgtctatttacctgggtccaa

SEQ ID NO: 905 - DNA, 1958 bp, Homo sapiens
atttcagaacaacgggataggatgatgacatcacaaggggatggggactcttgtcgtctcagagagaacgtgccagcctggctctgctttcttttcctagagggtctaacacctctcccggccctgacatctagctggttcctgaggaggaggcagaagtcatgaggaggcaatggggaaacagccatggcagccagtgcctgcctgtggatgcttggacattaaagggtcaccagctgagtgtgggctgagtgtccctgaacacaacatttgtgcttaggaagaacccattccagagctgagagagaaggatgccaacatgctgcttcctccctctttctgggggcatttcttctgcccctccaatcccatctctgagagctggtcccaggtccagcccaagcaggagaggcagccctcaccttcccaggtgtttgtaggcatgttactctccctcctagagagtgttccccgcagctccgccttccctgcaggcctcctccatcctctaaagcacaaatcatcaccacctgcacaactcgaatgtctttctcagccatgcctgattcctctgcaggaaggaaaaaggaagcagttcctggtagtgtatggagggacccacagaaaagccaagagcccacagcagatattgcttgttttttacctctaactactctggagtgcaagaaagggcatccattgtaaagtccaactcttaccaagtgggtgaggctatagacatcttgtctctttcttcagctgtgcagctcagacaggcccagatgttgagctcatgcaggagctagacccatacctgcgcatcatgtggatgaggcctttgtctagcctatgtgtctgaggctcctagataggcaaaggccatgaagttggggagaacctgtgagatgggatgaaactcaggaaggagtataaggctgtgggtgtcaagccccccagccccagcaaagctaaatacttccagcagcaacttcctagcttgaagcaaccttgtctgttcaattttataatcacaaaggaaaaagtgtcccagtcccctggcctttcctctcatcacaatccccttcctctgacatcacagaggcaagaactgtcttctctgctcggagcactgagtcgagggcatctccaggacaggcattcaggcagagcaagctccaggtttcaccacaatgcccatccctgcctccccactccacccacctctgccttccttactgctgtatctgctgcttgaactggcaggagtcacacatgtgttccatgtgcaacaaacggagatgtcacagactgtatcaactggggagtcaatcatcttgagttgcagcgtacccaataccttaccaaatggacctgtcttgtggttcaagggaacagggccaaaccggaaattaatctacaatttcaaacaaggtaactttcccagagtaaaagagattggagacaccaccaagcctggcaacacagacttttccacccgcatccgtgaaatctctcttgctgatgctggcacctattactgcgtgaagttcataaaaggaagagctatcaaggagtaccaatcaggtcggggcactcaggtgtttgttactgagcagaatccaagacctcccaagaacagacctgcaggcagagcaggctccagggcccaccatgatgcccatacctgcctctcggccctgcctgagagaaacagcacaaactatttcgtccaaccctgctgctgcctccggctgctgggactcacaggcttgctgtcaaaataatccaaacagggaaggaacgtacaagtaaataacaaaagcccccatactcttctgactccctggagacagctactttttaggagtttcatttgccttcttcaagagagctttcttccactgacataaaatgccagcttgatcgtacaataaatctgtctatttacctgggtccaa

SEQ ID NO: 906 - DNA, 2247 bp, Homo sapiens
accagatttgaagattgtaccaggagagccgcagtgttccagagctactgaggggctgggccgggatttgctgtattcgagaagacccccttggacccgagaggctgtgggcttggggagcatgaggaggtttcacagcagaaaggacaccccggggctcctggataagccagaaaatgtgccaggggaagtcgggctccaagggcaccactctgggcttccagctgtgtgggctggaccaagaaggctcagagaaatgatctcaggcttgaagtggggagaagaaactgtattatgaaggcagatgaacagttcctgcaaaagccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacatctctgaagaggcaaagacactcacaatggacatattgacattggctcacacctccacagaagctaagggcctgtcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactaacacaaaaccacacatcactgaggtcacagcctctgccgagaccctgtccacagccggcaccacagagtcagctgcacctgatgccacgattgggaccccactccccaccaacagcaccatagaaagagaagtgacagcacccggggccacgaccctcagtggagctctggccacagggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagccccttggaagccgccctcaagaacttcaccccttcagagacactgaccacggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggccc

SEQ ID NO: 907 - DNA, 3408 bp, Homo sapiens
gctccagtcctggcatctgcccgaggagaccacgctcctggagctctgctgtcttctcagggagactctgaggctctgttgagaatcatgctttggaggcagctcatctattggcaactgctggctttgtttttcctccctttttgcctgtgtcaagatgaatacatggagtctccacaaaccggaggactacccccagactgcagtaagtgttgtcatcatggaaacaatggcaacaatggagccactggtcataaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtaaatatatgactagaatagctccactttggggaagacttgtagctgagctgatttgttacgatctgaggaacattaaagttgagggttttacattgctgtattcaaaaaattattggttgcaatgttgttcacgctacaggtacaccaataatgttggacaattcaggggctcagaagaatcaaccacaaaatagtcttctcagatgaccttgactaatatactcagcatctttatcactctttccttggcacctaaaagataattctcctctgacgcaggttggaaatatttttttctatcacagaagtcatttgcaaagaattttgactactctgcttttaatttaataccagttttcaggaacccctgaagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtggggtcaggaggttgaggttcactattaacaaatgtcataaatatctcatagaggtacagtgccaatagatattcaaatgttgcatgttgaccagagggattttatatctgaagaacatacactattaataaataccttagagaaagattttgacctggctttagataaaactgtggcaagaaaaatgtaatgagcaatatatggaaataaacacacctttgttaaagatactttctaaacttgtgtttaataaactttaatagtcatagaattgtaaatcactatggttaacagaaagtgaaaatattttcatgcagatgatgtgaacagccatgtgaataggtgacttgggcacacagcagggtcatatgacttcagaaaacttcgcttttcagttattccattgttataatgtcaaccctttaagacattgatgtttagagggctcacaaataaaatctgaatacctgtaaggaaagaggttttttatcacataccttaagtctttgtaatgttcatgcttaaattctaagttttcaccttagtgacacacaaggtttggttgtaggcaacaagtcccaggtgtgtgggaaattgattcacaacagagatgggaaaaggtgcagataatttccaatgccttcacaatttacccatgaccagaaatatacttggaagactgatttcacaagtgtcccaaaactgagatgctaaaaaggaaacagtaggtaggtgtcataggaaatttacatgtaccatctaataaacaaacttgcaaattctaaatcttttttttttttgagacagtttcacgctgctgcccaggctggagtgcagtggcatgatctcagctcaccgcagcctccgcctcctgggttcaagtgactctcctacctcagcctcctgagtagctgggactacaggcgcccaccaccaggaccagctaatttttaatgtttctaatagagatggggtttcaccatgttgaccaggccggtctggaactcctgacctcaggtgatctgcctgcctcggtcttccaaagtgctgggattacaggcgtgagcccccgcacccagccgcaaattctaaatcttaaaacaactctgcaaacgaagcacttgagtttctgcttgcttcagggatgtaatatggtgtagaactgtttcacataatgatcagccttggtaattttccagtgtagaaaacattatatttgacccttggacaacaaagagattatattgaaggaattttattgattgtatcatgaataaaagctgaagtcaaaattaaaatgtaaaaaaataattcagaggatggaatatgcaaatgtaaactccaaatgatgtggctggaattcataaacatttactttatgcaagatactgtgctattccaggcactcctatggcatttaaagtacaattcttaccttccctaatttttcaacctagtagaggacaataggctaaagggaataagtacatggataacaaaacataaagtagaatgtttttacagccatagaaggcaaagggctaggaattcacaggagagagaaacagtatctagctgagagcataagaaaagcttgtggaaaagataatatctgatggccagagacaatttcttgctttggtatgtttgaagtgttatatttaaatatatatatttttatttaaaaaactcactatagaaaatttataaaattccccaaaatatttagtataaaattaatcatcccatcaaatattaaataatattactattttaaagtgtttatttcagtcttttcctgcatgtatttatggcttttatttttaaatatagtaataaaataatttgaaattagctttttatatatttttgtatcttgctctaatgggttggactaaacatattaagaacactctcaaatgctactaaggacaatttgaaaacataattttaatgactgcataatttatttaactttcctgttttggaaaatattattttttttttattacaaataatatgtcatgagcattctctttttaaaaaaataaactatgtgtgcat

SEQ ID NO: 908 - DNA, 2802 bp, Homo sapiens
ttttggcttttgggaagtcatggggaaaagaagtaaagctgagggtggcgaaatacctttgctaaacccagagacactgcacctgaatcctgctcagtgttttgtaggcaaccaactgccttctgccactggtatccggaaggggaaatgagttaccttaagtgggccaaagtggggaaatactaacagtacagctagaaaccaagagctgtcgtgaaagccctgaatgggttcccactgctatttcagacaaaactgatgcagttaagcctgaatttcctggcaagcacaagggtagatttttccaaaaggctttttagactgcaaatacacagcctttccatgtctaatcacaaaagcaaactgctggacacatgctctctgttcccagctggttgtgtatgttttcttcacacttcaacagaaacgtgccaaggtgtgacatttatgaatttcgccaactgggaactgtgcacacaaatcgttcttgcttgtggtgtgggaaaatgatgaatgggggctgttctgcctggggaggagggctgctgtcactctggcatgcctacagccttatttattacacaccaaagtataaaaccactccgccgctgcagctctcagctccagtcctggcatctgcccgaggagaccacgctcctggagctctgctgtcttctcagggagactctgaggctctgttgagaatcatgctttggaggcagctcatctattggcaactgctggctttgtttttcctccctttttgcctgtgtcaagatgaatacatggaggtgagcggaagaactaataaagtggtggcaagaatagtgcaaagccaccagcagactggccgtagcggctccaggagggagaaagtgagagagcggagccatcctaaaactgggactgtggataataacacttctacagacctaaaatccctgagaccagatgagctaccgcaccccgaggtagatgacctagcccagatcaccacattctggggccagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtaaatatatgactagaatagctccactttggggaagacttgtagctgagctgatttgttacgatctgaggaacattaaagttgagggttttacattgctgtattcaaaaaattattggttgcaatgttgttcacgctacaggtacaccaataatgttggacaattcaggggctcagaagaatcaaccacaaaatagtcttctcagatgaccttgactaatatactcagcatctttatcactctttccttggcacctaaaagataattctcctctgacgcaggttggaaatatttttttctatcacagaagtcatttgcaaagaattttgactactctgcttttaatttaataccagttttcaggaacccctgaagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtggggtcaggaggttgaggttcactattaacaaatgtcataaatatctcatagaggtacagtgccaatagatattcaaatgttgcatgttgaccagagggattttatatctgaagaacatacactattaataaataccttagagaaagattttgacctggctttagataaaactgtggcaagaaaaatgtaatgagcaatatatggaaataaacacacctttgttaaagatactttctaaacttgtgtttaataaactttaatagtcatagaattgtaaatcactatggttaacagaaagtgaaaatattttcatgcagatgatgtgaacagccatgtgaataggtgacttgggcacacagcagggtcatatgacttcagaaaacttcgcttttcagttattccattgttataatgtcaaccctttaagacattgatgtttagagggctcacaaataaaatctgaatacctgtaaggaaa

SEQ ID NO: 909 - DNA, 3424 bp, Homo sapiens
gtgagtagtgcctcctcccatctctcttgctcctggtctcatcgtgacgggcctggtcctgcctcactttctgccatgactaagagctccctgaggcctctccagaagcagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccagg

SEQ ID NO: 910 - DNA, 234 bp, Homo sapiens
atggccacaaggagcgtcctcttggccctcgtggtccttaacttactcttctatgttccaccaggtagaagtggacccaatgtctacatacaaaaaatctttgcttcatgttggcgactgcaaggtacttgccggccaaaatgtctaaaaaacgaacaatatcgtattttgtgtgatactatacatttgtgctgtgtaaacccaaaatatttacctatactgactgggaaatag

SEQ ID NO: 911 - DNA, 237 bp, Homo sapiens
atgaacctctgtctttctgcattactctttttcctggtgatcttactgccttcaggaaaaggtatgtttgggaatgatggagtcaaagttcgcacctgcactagccagaaagccgtatgtttcttcgggtgtccgccaggatacaggtggattgcgttctgccacaatattctgtcttgctgtaaaaatatgacacgttttcaacccccgcaagccaaagatccatgggttcattaa

SEQ ID NO: 912 - DNA, 831 bp, Homo sapiens
ccctgggccttcccccaggaagagccccacggccagctccttcctgttcccctggcggcccctcgcttcttccttctggatgggggcccagggggcccaggagagtataaaggcgatgtggagggtgcccggcacaaccagacgcccagtcacaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtgaaactgggagccttaggtgggaatacccaggaagtcaccctgcagccaggcgaatacatcacaaaagtctttgtcgccttccaagctttcctccggggtatggtcatgtacaccagcaaggaccgctatttctattttgggaagcttgatggccagatctcctctgcctaccccagccaagaggggcaggtgctggtgggcatctatggccagtatcaactccttggcatcaagagcattggctttgaatggaattatccactagaggagccgaccactgagccaccagttaatctcacatactcagcaaactcacccgtgggtcgctagggtggggtatggggccatccgagctgaggccatctgggtggtggtggctgatggtactggagtaactgagtcgggacgctgaatctgaatccaccaataaataaaggttctgcagaatcagtgca

SEQ ID NO: 913 - DNA, 2121 bp, Homo sapiens
ctccattaaaccaccaccagctccccaagccaccccttcagccatgaagttcctgctcctggtcttggcagccctcggattcctgacccaggtgatcccagccagtgcaggtgggtcaaaatgtgtgagtaacaccccaggatactgcaggacatgttgccactggggggagacagcattgttcatgtgcaacgcttccagaaaatgctgcatcagctactccttcctgccgaagcctgacctaccacagctcatcggtaaccactggcaatcaaggagaagaaacacacaaaggaaagacaagaagcaacaaacgaccgtaacatcataataaccactgctatcgcctccaccaactcagagaaatatcatttccacagttccaattcctcctacattgctgagtactagccaaggctcctctttatggggcagatatctatagccaaccccaaaacttctgtcttctatcattctgtcattcatctagtaactaatttggagtttgtatctatcttacgagaacaatcatcatgcagattcgtccacaggggatctgtcagtttgggtcctccaaatgaaaaatgtcaagacagaattggacatgcaaaagattgactgggagaacacacctctgatggacaaaggtgagacagagcagccacaggcagggagagccttcagactgcaacgctggcctgatacgtgtcaaaggagagagggatagaggaggattgaatagaaggagactaagactgcagctctaagaaagtctcagccaaacagatggggaggcccaaagcaaggcttgcccctcagaggagctcacgcagggcaggaatagccaggttctcatatcccaggggttcagactttggctgagaacagcccctggagaacatggggtgactgctaccataggtctggaagtatgaggctgtccaccaactatccccttgaagcaagttctcttgaaaggaaatctaaacagtgcacccccatggctgccacggagtataaggagggagagaaaggagctgaaagtctaggtttggccagctaggtagactgacttgtgaggtatttatttattcatttgagtaacaaagcagacagaatacatagccaccattggtagtacaccccaaaagcaaggatggcatgatgctggtgactcaaacgtgcctactcatggtgtcaaattggcataatcctcttgggaagctgtgtggaaataagcacagagaagcagaactctaattgcttaatccactaaacattacttctgggaattggctcatcataaattatccaagagaagcacaaagttatgggcacaaaggttttccatataatattatttaaaatgctgagaaaatgaaaaaatctaaatggtgaaatatatactaatgccatctataaatacaaacaaatagaatgtttatagaataatggaacataataacattattcaaaattgcatttatgctatagttgtcaaaattgtctccttatatgatacaaaactcatgaaaattatgacttttttgtttggttggaaagcagaattatgcataaatttcctcttacagttcgatgcccattagttttatataacatttatttgacacgtactgacttctatctgagaagaacaaaccaaaacactcaggcctaaataattaaaaacggtcctaaaaactagcaaaccagataagaaaagatgttaatgcccattccctaacttatgtcttagaccaaaattaattctagatggttttaaaatgacagtgtaaaagtaaagtattaaaagattgtgtggtcaaatattcaatttaagagcaaggaaattcttataaatataacaatagaggcagaactcatgtaagaataaattgattaggtggtattaaatattaagttcttatgtatgtcaaaagatatcattttgaaattcatccatcttattgggtattgcaggagttcattcctttttgtttataaatactcttccgtcatatgaatagtattcatttgtatactggtttgttgatggacatttgggttgttcccagtttatggctattacaaataaagcttctatgaacatttatgtacaaa

SEQ ID NO: 914 - DNA, 566 bp, Homo sapiens
cattgcacgccggggtccttgcccgctccctctctctgccaccgctcaaagcctgggagaacgcttttgaaagcgaatcaggaaattacttatcaatctgaagccccaaagaattatgaataatcctcgctgccaaagggaaggggattttgagcaaaagctccacatctgcgcacactagagttcaaagactccagctgttggaaggtcttgtgagcaatagccaaagatgtttgtcttgctctatgttacaagttttgccatttgtgccagtggacaaccccggggtaatcagttgaaaggagagaactactcccccaggtatatctgcagcattcctggcttgcctggacctccagggccccctggagcaaatggttcccctgggccccatggtcgcatcggccttccaggaagagatggtagagacggcaggaaaggagagaaaggtgaaaagggaactgcaggtttgagaggtaagactggaccgctaggtcttgccggtgagaaaggggaccaaggagagactgggaagaaaggacccataggaccagagggagagaaag

SEQ ID NO: 915 - DNA, 514 bp, Homo sapiens
ctctgaggaaggtagcatagtgtgcagttcactggaccaaaagctttggctgcacctcttctggaaagcctggccatggggctcttcatgatcattgcaattctgctgttccagaaacccacagtaaccgaacaacttaagaagtgctggaataactatgtacaaggacattgcaggaaaatctgcagagtaaatgaagtgcctgaggcactatgtgaaaatgggagatactgttgcctcaatatcaaggaactggaagcatgtaaaaaaattacaaagccacctcgtccaaagccagcaacacttgcactgactcttcaagactatgttacaataatagaaaatttcccaagcctgaagacacagtctacataaatcaaatacaatttcgttttcacttgcttctcaacctagtctaataaactaaggtgatgagatatacatcttcttccttttggtttcttgatccttaaaatgaccttcgagcatattctaataaagtgcattgccagtt

SEQ ID NO: 916 - DNA, 655 bp, Homo sapiens
gccatacacttcagcagagtttgcaacttctcttctaagtctttatccttcccccaaggcatgcctagcacaggactcttgaacagtgatgcctcaattagagttgctagccaatagattgaagctatgttggcacaatatcctacatcctcccgatctactggctgagcccaaccccacctaagaaggacaataaagatctgtgttcagagtcatactgaatagagacttctggactctatagaacccactgcctcctgatgaagtccctactgttcacccttgcagtttttatgctcctggcccaattggtctcaggtaattggtatgtgaaaaagtgtctaaacgacgttggaatttgcaagaagaagtgcaaacctgaagagatgcatgtaaagaatggttgggcaatgtgcggcaaacaaagggactgctgtgttccagctgacagacgtgctaattatcctgttttctgtgtccagacaaagactacaagaatttcaacagtaacagcaacaacagcaacaacaactttgatgatgactactgcttcgatgtcttcgatggctcctacccccgtttctcccactggttgaacattccagcctctgtctcctgctctaggatccccgactcattaaagcaaagaggctta

SEQ ID NO: 917 - DNA, 2500 bp, Homo sapiens
aaacccgcggcactaagctctctctgagaggcagaattgcgccggccgccggcgagaatctgcctagagccgtccagccctgtcggccggggacgacagccgcctcagcctgtcaggacagtgaggagagcaggggccgagtctctcggaagccctcgtgaggactcggacctattcggactgattcggcttcccacttcggggaacttcgaccctcctcggttcaggactcggtctcggctcggcggcttcgtgcaggttcggctcctactcgggcagcctctgttcgcctcggctccgctccgcgggcggactcggctcggctctgctcggcggctggctgccttttcggtccctattcgggcggcggcttcgggcggcctcggcccagctcgggcgtcctcttcgggccccgcttcgggctccgcgaccggcgcttcgggcggtcccggacggcgccttcgggaaggctcggcggagtccggatggaggactcggactcggcggcaaagcagctgggcctggctgaggcggcggcggtggcggccgcggccgctgtggcggcggcggccgcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtc

SEQ ID NO: 918 - DNA, 587 bp, Homo sapiens
atgaatatcctgatgctgaccttcattatctgtgggttgctaactcgggtgaccaaaggtagctttgaaccccaaaaatgttggaagaataatgtaggacattgcagaagacgatgtttagatactgaaaggtacatacttctttgtaggaacaagctatcatgctgcatttctataatatcacatgaatatactcgacgaccagcatttcctgtgattcacctagaggatataacattggattatagtgatgtggactcttttactggttccccagtatctatgttgaatgatctgataacatttgacacaactaaatttggagaaaccatgacacctgagaccaatactcctgagactactatgccaccatctgaggccactactcccgagactactatgccaccatctgagactgctacttccgagactatgccaccaccttctcagacagctcttactcataattaattaacatttacttctggtatggaacaactagaaatactgctggaaataatatccaaagagctgattctaccaatccaatttcaccaggaaaattccatcagggattggatgaccat

SEQ ID NO: 919 - DNA, 1219 bp, Homo sapiens
gcggccgcggagggaaggggtgggtcggtgggtctgacagcgggtctgcgtaggcggcagcgtctgtccctcccagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaagatcctggctggctatgacctcgcgctggtgcaggaggtgcgagacccagacctcagcgccgtgtccgcgctcatggagcagatcaacagcgtgtccgagcacgagtacagctttgtgagcagccagcccctgggccgggaccagtacaaggagatgtacctgttcgtgtacaggaaagacgcggtgtcggtcgtggacacctacctgtacccagaccccgaggacgtcttcagccgcgagcccttcgtggtcaagttctcggcccccggcaccgcacagaacctggtgctgatcccgctgcacgcggcgccgcatcaagccgtggcggagatcgacgcgctctacgacgtgtacctggacgtgatcgacaagtggggcaccgacgacatgctgttcctgggcgacttcaacgccgactgcagctatgtgcgggcgcaggactgggccgccatccgtctgaggagcagtgaggtcttcaagtggctcatccctgacagcgccgacaccacggtgggcaactcagactgcgcctacgaccgcattgtggcctgtggcgcccgcctgcgccggagcctgaagccccagtcggccaccgtgcacgacttccaggaggaattcggcctggaccagactcaggctcttgccatcagcgaccactttccagtggaggtgaccctcaagttccaccgatgactcgaggcctggctggggcatgccacctgcagaccctggctctgaggaatggcccaacagtggccccttcagggtggcagccacccttcagtgaggccccaaggcagagtcggctgggcgtggaccaggggccatggacacgtgatgtgctgctctgtacctccgttccccatctgtgggacgggctgcatccagcgacctcatggggtgttgtgagccccatgaggggtgcagggggcactgcccggcagatgtctgctcaataaatgagctgctcccggtcgggcccc

SEQ ID NO: 920 - DNA, 3331 bp, Homo sapiens
gacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcaggactgagggagctggccgtgcgactgggcttcgggccctgtgcagaggagcaggccttcctgagcaggaggaagcaggtggtggccgcggccttgaggcaggccctgcagctggacggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcacggtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaa

SEQ ID NO: 921 - DNA, 2492 bp, Homo sapiens
ccggcatttgcgtttggggcgccctccctgcgccgggggcgggagcccagcgagcgcagagccccggccccgcgcggcccgagtgccacatcactgcgctggccgtccaaggtccgccgccccaccatgccgcccccgctgccgctgctgctccttacagtcctggtcgtcgccgctgcccggccggggtgcgagtttgagcggaaccccgccggtgaatgccacaggccaccagctgcagacagcggtacagtaccgggacctccctggcttctgttctgtaggagggctgcagcccccacactgtcagagcactttaggcagctgaatccgtgatttcagaagctctgattcctgcacagtagctgttgtcctggtcctcccctgccagaccgtgggtgcccctccctgcaggccctggccctgcgtggggtcccctacgtaaatgtctgatgcgtgacggtcagggccactgcaggagggactgacctgccgaccctgcctccccagccacctgcgtggacctgcagctcaggacctgcagtgatgccgcctacaaccacaccaccttccccaacctgcttcagcaccggtcatgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacatactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccactgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttgcactggaa

SEQ ID NO: 922 - DNA, 491 bp, Homo sapiens
ccttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaaga

SEQ ID NO: 923 - DNA, 464 bp, Homo sapiens
atggggaacccgggcggggtcgggtcggagcgcatgcgcgttgcgcgccggacgcggaacgtctgccggtgtccccgcgctgctggtcccggggtccctgaaccgcgggcggccccgctccctctgctggccatggcccccccgcccgcgtgccggtccccgatgtcaccgccgccgccgccgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggcacgcctg

SEQ ID NO: 924 - DNA, 1607 bp, Homo sapiens
atttttacctagaaacctttctagcctctcctcatctcttgactgtcttggccttggcaagaagaatacacgtccctacccagctatcttcagctcctgtccttcctcccagctgccagagaattgtcagcaggaggaatggcaccagctgtgacccggctccttttcctccagcttgttctggggccaactctggtcatggacatcaagatgcagattggcagcaggaacttctataccttaagcattgactatcccagggttaactacccaaagggtttccggggctattgtaatggtctgatgtcctatatgcgaggcaagatgcaaaattcagattgcccaaagatccattatgtgatacatgccccttggaaggccatccagaagttctgcaagtatagtgacagcttctgtgagaattacaatgaatactgcacactcacccaggattccctccccatcacggtctgctccctgagccaccaacagccacccactagctgctactacaatagcaccctaaccaaccagaagctctacctactctgctcccgcaagtatgaagctgatccaataggtatcgctggtctctattcgggaatttaattcctgagccactccccaacctctaccaccacaggccagctgtctccatttccaacactctgatccctgtaacaagacttccttcctgacttacgaggcaggcagggtcccctcccaagagaccaggtgggtgcgaaaatgtccagggctttgatcaccatgcaaagtggtgctatcttctaggttctttccagcttgtttaccccctcttcgcccccacctcctcatcatccttcctctcccagagacagtaaaacccacccaagaagttgactgtgtccagttggcagtgactgtccacccactgggccagatcctaagtcctggatggaggcccagggcctcagctcacaccatggcaacaggcaccagctccgagtctcacctccccatccccaccagccttctcatgtcagcctcccccagttcccttataattccctccactcacccacctactcaggggatatggctagctataggaacctccctgaggccctcagactcatgttagcctcacttccccacaacccccagtttccagcctgcttctctctgtgaaatcatggtttctcccttcatataactgtcctctcctgcttcctcttaccatggagcctaggactgtctcccccacactcccaacaaccgtagtcaccctgccttcctttttccaacctctttttcttccagtcttcttaccttggctcactggcatttcaaggtatcttctctcacccattccccagaggttcctgcttcccttctcttccagaagctcctcccaaatcccccagactccagagtctgcccctgaccaggcagcgaatgaggcaggcccggctctaatcgaacataaatttctaaaaccacatctgagtatgtaagatgtaaccattgggggaaactgggtgaagggcacacgagccccctctgtaccattttttgtaacttcctgtcaacccataatcaattcaaaataaaaagttaataacaca

SEQ ID NO: 925 - DNA, 444 bp, Homo sapiens
atgataataatggtgataattttcttggtgcttctgttctgggaaaatgaggtgaatgatgaagcagtgatgtcaactttagaacacttgcatgtggactaccctcagaatgacgttcccgttcctgcaaggtactgcaaccacatgatcatacaaagagttatcagggaacctgaccacacttgtaaaaaggagcatgtcttcatccatgagaggcctcgaaaaatcaatggtatttgcatttctcccaagaaggttgcttgccaaaacctttcggccattttctgctttcagagtgagacaaagttcaaaatgacagtctgtcagctcattgaaggcacaagataccctgcctgcaggtaccactattcccccacagaggggtttgttcttgtcacttgtgatgacttgaggccagatagtttccttggctatgttaaataa

SEQ ID NO: 926 - DNA, 674 bp, Homo sapiens
agtcatgcgttttatggcaggccctgcagggagccagagtctgggtcccctgtgcttccacagcagcccccaagccctctacacggtcctcttaatagtgctggtcatgatgagcttggtgtttggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcct

SEQ ID NO: 927 - DNA, 3971 bp, Homo sapiens
gacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 928 - DNA, 730 bp, Homo sapiens; identical to SEQ ID NO: 455

SEQ ID NO: 929 - DNA, 761 bp, Homo sapiens
agagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 930 - DNA, 4070 bp, Homo sapiens
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 931 - DNA, 451 bp, Homo sapiens
ggggtgtagaaacaggcctgttaaggagaggccaccgggacttcagtgtctcctccatcccaggagcgcagtggccactatggggtctgggctgccccttgtcctcctcttgaccctccttggcagctcacatggaacagggccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgaccctgtctttcagcaggcccccaccctcctgagtggcaataaataaaattcggtatgctgaattcaa

SEQ ID NO: 932 - DNA, 4299 bp, Homo sapiens; identical to SEQ ID NO: 841

SEQ ID NO: 933 - DNA, 4510 bp, Homo sapiens
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 934 - DNA, 3523 bp, Homo sapiens
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 935 - DNA, 4070 bp, Homo sapiens
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacactgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 936 - DNA, 4299 bp, Homo sapiens
gcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacactgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 937 - DNA, 4510 bp, Homo sapiens
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacactgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 938 - DNA, 3523 bp, Homo sapiens
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 939 - DNA, 3650 bp, Homo sapiens
ttatttctctgaaacctaaaatccctctcagcccagaagtgacacacaccaaacctgccccagaacctcagactctactgccatcacagtcaacaataggacctgaaacaccaggaaccaaaccttcaacaacattagctctggaacctgccacgatacaaccggagcccttggtgcccacaactgcctcaaaaccatctgagagacctaaaaccacacacagaccagatgcacctcaaattcagcctggttcaaaaccaccaaaacaattacttcctaaaccccaaaccacagcagaaccagacatgccaccaactaaatccgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggttcctgccacaatcctcgaaccagttcttagaactgaggcttcagggacaacagcagttcctgctacaatctttgaaccagtttctcctataaaagaggctccagggacaacattcgttcctgttacagacctcgagcctgttacttttagaactgagatccctgcaacaaccttagctaccaaaacatcaaaaagaacccgccctccacgtcccagacctaaaactacaccgagccctcaggcacctgagaccaaacctgttcctgctacagtcctagaacctgtcactcttagacctgaggcctcaacaacattagcttccaaaacatcacaacggacacgtcgtccacgtctcagaacaaaaaccacaccacgtcctgaagcacctgaatccaaaccagttcctactgcggagctcaaacctgttacactcagaactgagacttgggtgacaacacaagctcctaaaacatcacaacgaactcgtcgtccacgtcccaaaactaaaaccacaccaagtcctgaggttcctcaaaccaaactggttccttctacagatcttgaacctggtactctcagaactgaagctccaaaaaccatggttgttactacagtccttgaacctgacacttttagaaccaagtttccagaaacaacgttagctcctaaaacacaacggacacgtcgtccccgtcccagacccaaaactacatcaagtcctgaagtacctcagaacaaatcggtttctgttacaggctttgaacctgttgttcatagtactgatgctccaggaacaacatttgctctgactgaactgcaaactcttattttgaaaccagtgacatcaccaagcctagaaatgacagaaagtcaacctgtttctgatgttctggaatcggttacacttagtactgagtcaccaaaggagaccatagcaccagccaaaacagactatgtatatcccactgccaaagcaccactctggccagaggagccaaagactgaagttgtggaatctattacatatgtatctgaaccacctgagaccacactagaaacgtcgcctctgccttctcaatctataaccctacccagcccagatgagcctcagactgaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtat

SEQ ID NO: 940 - DNA, 4272 bp, Homo sapiens
atggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttacccacacctagtccagaagtgcccaagtccaaacccgctctggaacctgccacgatacaaccggagcccttggtgcccacaactgcctcaaaaccatctgagagacctaaaaccacacacagaccagatgcacctcaaattcagcctgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggctcccaaagtgcctcaacgaactcatcgtccacatcccaaacctaaaaccacactgagtcccgaagagcttcagactgaactggttcctgttacagacctcgagcctgttacttttagaactgagatccctgcaacaaccttagctaccaaaacatcaaaaagaacccgccctccacgtcccagacctaaaactacaccgagccctcaggcacctgagaccaaacctgttcctgctacagtcctagaacctgtcactcttagacctgaggcctcaacaacattagcttccaaaacatcacaacggacacgtcgtccacgtctcagaacaaaaaccacaccacgtcctgaagcacctgaatccaaaccagctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagttttttttt

SEQ ID NO: 941 - DNA, 4731 bp, Homo sapiens
ctttccggccctggtgagggagctggcggactcgcgcgaacgttcgcgggagaacgccaggaagggcagatggttcctcgactctgagcccctccctgctgcgctcgccgggtcgaggccgctcgccgggctgaagccgctccgagcgtcgggccccgcgccctggccctcctgggtgtagtcccggtcctgcctctgcggggcccgagcccgcccacggcgccggctggccaaggtgtcccagctgctccttggcgccccctggcccagctcccgcgcccgaggtttccggtgagcggcagtagccggttatgacgactccctcctctggaacagccgccgtctcctccgcctcctcctcggtagttcacggctgccccggctccaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagtgggtacatgccctcgccagacgccagctttctgatctgcgtctttagattttttccatcgcctaagcgttacttctccactgatcggttttagagacctgaaacatcacagaagcttctgagtggttctgaagattcaagaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgccagagagaggctggaggagatgcatgtgctctgtcagcctaaggaaacgagtgactcaagtctggtgtgttcccgttatcttcagtactgcagagcaaccaatctctatcttgatttaagaaacatcaagagaaatcatgacagatttaaggaggactttttccagagtggtgaaattggagggcactgtaaacttgacatccgtacattgacgtctgaaggtcagcgcaaaagccctctgcagtcatggtttgctgagctacaaagctatactcagctcaacttcagacctatagaagatgctaaatgtgacattgtcattgaaaaaccaacatatttcatgaaattagatgcaggtgttaacatgtatcaccacttctgtgatttcatcaatctttatattactcagcacgttaataactcattcagtactgacgtgtacatcgtgatgtgggacaccagttcttacggatatggtgacctattctccgacacatggaatgcatttactgattatgacgttatacatttgaaaacttatgattccaaaagggtatgttttaaagaagctgttttttcattactcccccgcatgaggtatgggctgttctataatactcctctgatatctggctgtcaaaatactggactattcagggcatttgcccagcatgtactacacagactaaacatcacacaagaaggacctaaggatggaaaaattcgagtcaccattcttgcacggagcacagaataccggaaaatccttaaccaaaatgagcttgtaaatgcactgaaaacagtatctacatttgaagtccagattgttgattacaagtatagagaacttgggtttttagatcaactaaggatcacacacaacacggacatatttattggaatgcatggagctggtctgacccatttacttttccttccagactgggctgctgtatttgaactgtacaactgtgaagatgaacgctgttacttagacttggccaggctgagaggcgttcactacatcacttggcgacggcagaacaaagtctttcctcaggataagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcatgtggtttttgtgtcattgctatttatcaatagcaataattttgcactgaaaactttttatagttcaaaaattaagcatggactccccagtatactttaactttctttctttctttttttttttttggagacagagtctcactgtcacccaggctggagtgcagtggcatgatctcagtttatgcaacttctgcctccccaggttcaagcgattcttttgcctcagccacctgactagctgggattgcagcctgcaccaccacacctggctaaatttttgttgttgtcgttgagatacagtttcactctgtcacccaggctggagtgcagtggcatgatctcagctcactgcaacctctgccttctggattcaagtgattcttgtgccttagcctcccaagtagctgggattacaggcgtgcaccaccacgcccagttgatttttgtatttttgatagagacggagtttcaccatgttggccaggctggtctcgaactctgggttcaagaaatcctcccaccttgcctcccaaagtgctgggattacaggtgtgagccaccacgcatggccctgaactttctctttttaggaataccaaagttttcaactttttcagctttagaatttgtaaatatttttgtagaatatcatatgactgtaattccagagtgttccaacttgtttatgatatatttgggtaaatttacaactgttcttttatttgccataatctggttataacactgtttgtggtaggaaaggaaaacatgcaaaacatacacacacacacacacacacacacacacacgcagagttgtgattctcagtaccaagctataggaccatgttatagatcagcgtttagtcacctccaggttatatgcatcgagaacctgaataaatcatgccactatattaatttatattacatgtttcatatttaaatcatgttttcctaaaatgtagcaactacatgtgataaaagcaaattagaacattctgtaggactgtcttgcataccttctgtctggtttccactgattccttcttagccatggagagcatttgtgattaattaatttatatatgaaataatggtttccattttatgcgagtatttgtaactgcatataccagtgcgtgtgcgtctacctctgtcagcatgaaagtattccagtctttaatttcaaaaacttcaaattagcctcatgaagagaatttttccctgtgaaaagtaagaccaagaaaaaacaaactaaagacatgtgacttattcaatgaaagtgaaaaagaagctctaaaacagtgtcattgattaaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttttgtgtgcaaaatactgagtaaccactgggaaaatatttcagatgaaagggatgacaaaagcatgttgcgctttgcatcagcaaggcattgacttctgaaaaaatgatctgaaaaaagtttcaccgtttgtcttcttacctcattttaagaagcatgtgaaaatgggatactatagactactgagaatttcagaaattgagaacaatttcataataaaacggctatatttgaagagagaatacattttatataaacaggaaaatacatttgacactttatggaattttatgagactttttgtgggaacagaaggtcttcaaattgtaaaatgtaaagattgctctttttattaagtctttaacagggatgtatttcattgtatgttttgggtatggctttggaataaatcattttatattttatttgaatatcagaacca

SEQ ID NO: 942 - DNA, 2704 bp, Homo sapiens
cgagggctcctgctggtactgtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaactaagaaaa

SEQ ID NO: 943 - DNA, 1483 bp, Homo sapiens
gccctggtgttcccacctcctcagagccatgaggcaggaatgttctccttatgtgactaggcacaggttccaaatggggaggggactggctcagcatccggagccaaaacaggaatagaactgggagctgagcctggagcggttctgggcttttggttctctgcatcaacacagccagcatgcctatgatttctgtgctgggcaaaatgtttctgtggcagcgtgaagggcctggaggacgatggacttgtcagacaagtcgcagagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgccccc

SEQ ID NO: 944 - DNA, 5256 bp, Homo sapiens
cacatgccccgtttgctgcctgaacctctccacaaagactcccagatcctgtagaattgaatttaatcatctcctgacaaaagaatgcaatttcaactgaccctttttttgcaccttgggtggctcagttactcaaaagctcaagatgactgcaacaggggtgcctgtcatcccaccactggtgatctcctggtgggcaggaacacgcagcttatggcttcttctacctgtgggctgagcagagcccagaaatactgcatcctcagttacctggagggggaacaaaaatgcttcatctgtgactctagatttccatatgatccgtatgaccaacccaacagccacaccattgagaatgtcattgtaagttttgaaccagacagagaaaagaaatggtggcaatctgaaaatggtcttgatcatgtcagcatcagactggacttagaggcattatttcggttcagccaccttatcctgacctttaagacttttcggcctgctgcaatgttagttgaacgttccacagactatggacacaactggaaagtgttcaaatattttgcaaaagactgtgccacttcctttcctaacatcacatctggccaggcccagggagtgggagacattgtttgtgactccaaatactcggatattgaaccctcaacaggtggagaggttgttttaaaagttttggatcccagttttgaaattgaaaacccttatagcccctacatccaagaccttgtgacattgacaaacctgaggataaactttaccaagctccacacccttggggatgctttgcttggaaggaggcaaaatgattcccttgataaatactactatgctctgtacgagatgattgttcggggaagctgcttttgcaatggccatgctagcgaatgtcgccctatgcagaagatgcggggagatgttttcagccctcctggaatggttcacggtcagtgtgtgtgtcagcacaatacagatggtccgaactgtgagagatgcaaggacttcttccaggatgctccttggaggccagctgcagacctccaggacaacgcttgcagatcgtgcagctgtaatagccactccagccgctgtcactttgacatgactacgtacctggcaagcggtggcctcagcgggggcgtgtgtgaagactgccagcacaacactgaggggcagcactgcgaccgctgcagacccctcttctacagggacccgctcaagaccatctcagatccctacgcgtgcattccttgtgaatgtgaccccgatgggaccatatctggtggcatttgtgtgagccactctgatcctgccttagggtctgtggccggccagtgcctttgtaaagagaacgtggaaggagccaaatgcgaccagtgcaaacccaaccactacggactaagcgccaccgaccccctgggctgccagccctgcgactgtaacccccttgggagtctgccattcttgacctgtgatgtggatacaggccaatgcttgtgcctgtcatatgtcaccggagcacactgcgaagaatgcactgttggatactggggcctgggaaatcatctccatgggtgttctccctgtgactgtgatattggaggtgcttattctaacgtgtgctcacccaagaatgggcagtgtgaatgccgcccacatgtcactggccgtagctgctctgaaccagcccctggctacttctttgctcctttgaatttctatctctacgaggcagaggaagccacaacactccaaggactggcgcctttgggctcggagacgtttggccagagtcctgctgttcacgttgttttaggagagccagttcctgggaaccctgttacatggactggacctggatttgccagggttctccctggggctggcttgagatttgctgtcaacaacattccctttcctgtggacttcaccattgccattcactatgaaacccagtctgcagctgactggactgtccagattgtggtgaacccccctggagggagtgagcactgcatacccaagactctacagtcaaagcctcagtcttttgccttaccagcggctacgagaatcatgctgcttcccacacccatctgtttagaaccagatgtacaatattccatagatgtctatttttctcagcctttgcaaggagagtcccacgctcattcacatgtcctggtggactctcttggccttattccccaaatcaattcattggagaatttctgcagcaagcaggacttagatgagtatcagcttcacaactgtgttgaaattgcctcagcaatgggacctcaagtgctcccgggtgcctgtgaaaggctgatcatcagcatgtctgccaagctgcatgatggggctgtggcctgcaagtgtcacccccagggctcagtcggatccagctgcagccgacttggaggccagtgccagtgtaaacctcttgtggtcgggcgctgctgtgacaggtgctcaactggaagctatgatttggggcatcacggctgtcacccatgtcactgccatcctcaaggatcaaaggacactgtatgtgaccaagtaacaggacagtgcccctgccatggagaggtgtctggccgccgctgtgatcgctgcctggcaggctactttggatttcccagctgccacccttgcccttgtaataggtttgctgaactttgtgatcctgagacagggtcatgcttcaattgtggaggctttacaactggcagaaactgtgaaaggtgtattgatggttactatggaaatccttcttcaggacagccctgtcgtccttgcctgtgtccagatgatccctcaagcaatcagtattttgcccattcctgttatcagaatctgtggagctcagatgtaatctgcaattgtcttcaaggttatacgggtactcagtgtggagaatgctctactggtttctatggaaatccaagaatttcaggagcaccttgccaaccatgtgcctgcaacaacaacatagatgtaaccgatccagagtcctgcagccgggtaacaggggagtgccttcgatgtttgcacaacactcagggcgcaaactgccagctctgcaaaccaggtcactatggatcagccctcaatcagacctgcagaagatgctcctgccatgcttccggcgtgagtcccatggagtgtccccctggtgggggagcttgcctctgtgaccctgtcactggtgcatgtccttgtctgccgaatgtcacaggcctggcctgtgaccgttgtgctgatggatactggaatctggtccctggcagaggatgtcagtcatgtgactgtgaccctaggacctctcaaagtagccactgtgaccagcttacaggccagtgtccgtgtaaattaggttacggcgggaaacgttgcagtgagtgccaggaaaattattatggtgatccacctgggcgatgcattccatgtgattgtaacagggcaggtacccagaagcccatctgtgatccagacacaggcatgtgccgctgccgggagggtgtcagcggccagagatgtgatcgctgtgcccggggacacagccaggaattccctacttgtcttcaatgtcacttgtgctttgatcagtgggaccacaccatttcttccctctccaaagcggtgcaagggttaatgagactggctgctaacatggaagataaaagagagaccctgcctgtctgtgaggcagacttcaaagacctcagagggaacgtgtctgaaatagaaaggattttgaaacatcctgttttcccatctgggaaattcttaaaagtcaaggattatcatgactctgttagaagacaaatcatgcagctaaatgaacaactgaaagcagtgtatgaatttcaagatctgaaagatacaatagaaagagcaaagaatgaagcagacctcttacttgaagaccttcaggaagaaattgatttgcaatccagtgtccttaatgcaagcattgcggactcctcagaaaacatcaagaaatattatcacatatcatcatctgctgaaaagaaaattaatgaaactagttccaccattaatacctctgcaaatacaaggaatgacttacttaccatcttagatacactaacctcaaaaggaaacttgtcattggaaagattaaagcagattaagataccagatatccaaatattgaatgaaaaggtgtgcggagatccaggaaatgtgccatgtgtgcccttgccctgtggcggtgctctctgcacgggccggaaggggcacaggaagtgtaggggtcccggctgtcacggctccctgaccctctcaacgaatgccctccaaaaagcccaggaagcaaaatccattattcgtaatttggacaaacaggttcgtgggttgaaaaatcagatcgaaagtataagtgaacaggcagaagtctccaaaaacaatgccttacagctgagggaaaaactgggaaatataagaaaccaaagtgactctgaagaagaaaacatcaatcttttcatcaaaaaagtgaaaaactttttgttagaggaaaacgtgcctccagaagacatcgagaaggttgcgaatggtgtgcttgacattcacctaccaattccatcccaaaatctaaccgatgaacttgtcaaaatacagaaacatatgcaactctgtgaggattacaggacagatgaaaacaggttaaatgaagaagcagatggagcccaaaagcttttggtgaaggccaaagcagctgagaaagcagcaaatattctattaaatcttgacaaaacattgaaccagttacaacaagctcaaatcactcaaggacgggcaaactctaccattacacagctgactgccaatataacaaaaataaaaaagaatgtgctgcaggctgaaaatcaaaccagggaaatgaagagtgagctggagttagcaaagcagcgatcagggctggaggatggactttccctgctgcagaccaagttgcaaaggcatcaagaccacgctgtcaatgcgaaagttcaggctgaatctgcccaacaccaggctgggagtcttgagaaggaatttgttgagctgaaaaaacaatatgctattctccaacgtaagacaagcactacaggactaacaaaggagacattaggaaaagttaaacagctaaaagatgcggcagaaaaattggctggagatacagaggccaagataagaagaataacaggctgttttcagaactcagcaagatag

SEQ ID NO: 945 - DNA, 5858 bp, Homo sapiens
cacatgccccgtttgctgcctgaacctctccacaaagactcccagatcctgtagaattgaatttaatcatctcctgacaaaagaatgcaatttcaactgaccctttttttgcaccttgggtggctcagttactcaaaagctcaagatgactgcaacaggggtgcctgtcatcccaccactggtgatctcctggtgggcaggaacacgcagcttatggcttcttctacctgtgggctgagcagagcccagaaatactgcatcctcagttacctggagggggaacaaaaatgcttcatctgtgactctagatttccatatgatccgtatgaccaacccaacagccacaccattgagaatgtcattgtaagttttgaaccagacagagaaaagaaatggtggcaatctgaaaatggtcttgatcatgtcagcatcagactggacttagaggcattatttcggttcagccaccttatcctgacctttaagacttttcggcctgctgcaatgttagttgaacgttccacagactatggacacaactggaaagtgttcaaatattttgcaaaagactgtgccacttcctttcctaacatcacatctggccaggcccagggagtgggagacattgtttgtgactccaaatactcggatattgaaccctcaacaggtggagaggttgttttaaaagttttggatcccagttttgaaattgaaaacccttatagcccctacatccaagaccttgtgacattgacaaacctgaggataaactttaccaagctccacacccttggggatgctttgcttggaaggaggcaaaatgattcccttgataaatactactatgctctgtacgagatgattgttcggggaagctgcttttgcaatggccatgctagcgaatgtcgccctatgcagaagatgcggggagatgttttcagccctcctggaatggttcacggtcagtgtgtgtgtcagcacaatacagatggtccgaactgtgagagatgcaaggacttcttccaggatgctccttggaggccagctgcagacctccaggacaacgcttgcagatcgtgcagctgtaatagccactccagccgctgtcactttgacatgactacgtacctggcaagcggtggcctcagcgggggcgtgtgtgaagactgccagcacaacactgaggggcagcactgcgaccgctgcagacccctcttctacagggacccgctcaagaccatctcagatccctacgcgtgcattccttgtgaatgtgaccccgatgggaccatatctggtggcatttgtgtgagccactctgatcctgccttagggtctgtggccggccagtgcctttgtaaagagaacgtggaaggagccaaatgcgaccagtgcaaacccaaccactacggactaagcgccaccgaccccctgggctgccagccctgcgactgtaacccccttgggagtctgccattcttgacctgtgatgtggatacaggccaatgcttgtgcctgtcatatgtcaccggagcacactgcgaagaatgcactgttggatactggggcctgggaaatcatctccatgggtgttctccctgtgactgtgatattggaggtgcttattctaacgtgtgctcacccaagaatgggcagtgtgaatgccgcccacatgtcactggccgtagctgctctgaaccagcccctggctacttctttgctcctttgaatttctatctctacgaggcagaggaagccacaacactccaaggactggcgcctttgggctcggagacgtttggccagagtcctgctgttcacgttgttttaggagagccagttcctgggaaccctgttacatggactggacctggatttgccagggttctccctggggctggcttgagatttgctgtcaacaacattccctttcctgtggacttcaccattgccattcactatgaaacccagtctgcagctgactggactgtccagattgtggtgaacccccctggagggagtgagcactgcatacccaagactctacagtcaaagcctcagtcttttgccttaccagcggctacgagaatcatgctgcttcccacacccatctgtttagaaccagatgtacaatattccatagatgtctatttttctcagcctttgcaaggagagtcccacgctcattcacatgtcctggtggactctcttggccttattccccaaatcaattcattggagaatttctgcagcaagcaggacttagatgagtatcagcttcacaactgtgttgaaattgcctcagcaatgggacctcaagtgctcccgggtgcctgtgaaaggctgatcatcagcatgtctgccaagctgcatgatggggctgtggcctgcaagtgtcacccccagggctcagtcggatccagctgcagccgacttggaggccagtgccagtgtaaacctcttgtggtcgggcgctgctgtgacaggtgctcaactggaagctatgatttggggcatcacggctgtcacccatgtcactgccatcctcaaggatcaaaggacactgtatgtgaccaagtaacaggacagtgcccctgccatggagaggtgtctggccgccgctgtgatcgctgcctggcaggctactttggatttcccagctgccacccttgcccttgtaataggtttgctgaactttgtgatcctgagacagggtcatgcttcaattgtggaggctttacaactggcagaaactgtgaaaggtgtattgatggttactatggaaatccttcttcaggacagccctgtcgtccttgcctgtgtccagatgatccctcaagcaatcagtattttgcccattcctgttatcagaatctgtggagctcagatgtaatctgcaattgtcttcaaggttatacgggtactcagtgtggagaatgctctactggtttctatggaaatccaagaatttcaggagcaccttgccaaccatgtgcctgcaacaacaacatagatgtaaccgatccagagtcctgcagccgggtaacaggggagtgccttcgatgtttgcacaacactcagggcgcaaactgccagctctgcaaaccaggtcactatggatcagccctcaatcagacctgcagaagatgctcctgccatgcttccggcgtgagtcccatggagtgtccccctggtgggggagcttgcctctgtgaccctgtcactggtgcatgtccttgtctgccgaatgtcacaggcctggcctgtgaccgttgtgctgatggatactggaatctggtccctggcagaggatgtcagtcatgtgactgtgaccctaggacctctcaaagtagccactgtgaccagcttacaggccagtgtccgtgtaaattaggttacggcgggaaacgttgcagtgagtgccaggaaaattattatggtgatccacctgggcgatgcattccatgtgattgtaacagggcaggtacccagaagcccatctgtgatccagacacaggcatgtgccgctgccgggagggtgtcagcggccagagatgtgatcgctgtgcccggggacacagccaggaattccctacttgtcttcaatgtcacttgtgctttgatcagtgggaccacaccatttcttccctctccaaagcggtgcaagggttaatgagactggctgctaacatggaagataaaagagagaccctgcctgtctgtgaggcagacttcaaagacctcagagggaacgtgtctgaaatagaaaggattttgaaacatcctgttttcccatctgggaaattcttaaaagtcaaggattatcatgactctgttagaagacaaatcatgcagctaaatgaacaactgaaagcagtgtatgaatttcaagatctgaaagatacaatagaaagagcaaagaatgaagcagacctcttacttgaagaccttcaggaagaaattgatttgcaatccagtgtccttaatgcaagcattgcggactcctcagaaaacatcaagaaatattatcacatatcatcatctgctgaaaagaaaattaatgaaactagttccaccattaatacctctgcaaatacaaggaatgacttacttaccatcttagatacactaacctcaaaaggaaacttgtcattggaaagattaaagcagattaagataccagatatccaaatattgaatgaaaaggtgtgcggagatccaggaaatgtgccatgtgtgcccttgccctgtggcggtgctctctgcacgggccggaaggggcacaggaagtgtaggggtcccggctgtcacggctccctgaccctctcaacgaatgccctccaaaaagcccaggaagcaaaatccattattcgtaatttggacaaacaggttcgtgggttgaaaaatcagatcgaaagtataagtgaacaggcagaagtctccaaaaacaatgccttacagctgagggaaaaactgggaaatataagaaaccaaagtgactctgaagaagaaaacatcaatcttttcatcaaaaaagtgaaaaactttttgttagaggaaaacgtgcctccagaagacatcgagaaggttgcgaatggtgtgcttgacattcacctaccaattccatcccaaaatctaaccgatgaacttgtcaaaatacagaaacatatgcaactctgtgaggattacaggacagatgaaaacaggttaaatgaagaagcagatggagcccaaaagcttttggtgaaggccaaagcagctgagaaagcagcaaatattctattaaatcttgacaaaacattgaaccagttacaacaagctcaaatcactcaaggacgggcaaactctaccattacacagctgactgccaatataacaaaaataaaaaagaatgtgctgcaggctgaaaatcaaaccagggaaatgaagagtgagctggagttagcaaagcagcgatcagggctggaggatggactttccctgctgcagaccaagttgcaaaggcatcaagaccacgctgtcaatgcgaaagttcaggctgaatctgcccaacaccaggctgggagtcttgagaaggaatttgttgagctgaaaaaacaatatgctattctccaacgtaagacaagcactacaggactaacaaaggagacattaggaaaagttaaacagctaaaagatgcggcagaaaaattggctggagatacagaggccaagataagaagaataacagatttagaaaggaaaatccaagatttgaatctaagtagacaagcaaaagctgatcaactgagaatattggaagatcaagttgttgccattaaaaatgaaattgttgaacaagaaaaaaaatatgctaggtgctatagctaggcagagttaaagagcaaaagcttgtgcctttgtttctggtttctgatgtacaagcccctggggctctgttgaacctgtgaaatactgacaatgtcttctaccttccttccccacaccctgtccttattagacacctgctcagtgtggctggaggttgaaatgccaccaggaaaatgccacttcataattgaaaggggaaagtaatgaaattgtctctggtttcagaaacttttcctcttaccttcctttctctttcctaacttaaaaataacagtttccatataacaagtagaaatttaagtaagtactctactaactaataatcatttcagtcagataaacctaaacattaaataaatatctccaatattaggatggaatacatatgtatggcatgtactagattgtcctatattttatgtttatttggatttgcttttatttgtaaaattattcttttctgaataaactgcatacaattcaaaatg

SEQ ID NO: 946 - DNA, 1801 bp, Homo sapiens
cttcgggcggcctcggcccagctcgggcgtcctcttcgggccccgcttcgggctccgcgaccggcgcttcgggcggtcccggacggcgccttcgggaaggctcggcggagtccggatggaggactcggactcggcggcaaagcagctgggcctggctgaggcggcggcggtggcggccgcggccgctgtggcggcggcggccgcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaagagatggagtcttactatgttgaccagcctggtctccatctcctggcttcgggcgatcctcccatgtcagcctcccaaagtgctaggattatag

SEQ ID NO: 947 - DNA, 2120 bp, Homo sapiens
gccccagcttggccgggcgcggagcggggcgcatggcgccgggcgcactgcgcgggggctgcgaacaaagggcccccggcggcggcgcgaggacggccgcgctcggaccctggccctggcccagccctggcccggccccctccccaggcgcggcgccccccaggagccgaaaaatgagcggcgccctgctctggccgttgctcccgctcctgctcctgctgctgtcggcgcgggacggcgtgcgcgccgcgcagcctcaggccccgggttacttgattgcagctccctctgtttttcgcgcgggcgtggaggaagtcatcagcgtgaccatctttaactctccaagggaagtcacggtccaggctcagctggtggcccagggtgagccggtggtgcagagccagggagccatcctggataaagggacaatcaaactcaaggtgcccacgggcctccggggccaagcgcttctgaaagtgtggggccgcggctggcaggcggaggaggggcccctctttcacaaccagacctcggtgaccgtggacggccggggcgcttctgtattcatccagacggacaagcctgtgtacagaccccagcaccgagtgctcataagcatcttcaccgtctctccaaatctgaggcctgtcaacgagaagctggaagcctacatcctggacccccgaggctctcggatgatagagtggagacacttaaagccgttctgctgcggcatcaccaacatgagcttccccttgtccgaccagcctgtgttgggagaatggttcatttttgttgaaatgcaaggccacgcgtacaacaagtcttttgaagttcagaagtatgtgttgcccaagtttgagcttctgattgacccgccccggtatatccaagacctggacgcctgtgagacaggcactgtgcgggccaggtatacctttgggaaacctgtggctggtgccttaatgatcaacatgactgttaatggtgtagggtactacagccacgaggtgggacgccctgtcctcagaacaaccaagatcctcggctcccgggacttcgacatctgcgtgagggacatgatcccagcggacgtccctgagcacttccggggcagggtcagcatctgggccatggtgaccagtgtggacgggagccagcaggtcgcgttcgatgactccacccccgtgcagaggcagctggtggacatccggtactccaaggacacgaggaagcagttcaagccgggcctggcctacgtggggaaggtggagctatcctaccccgatggcagcccagctgagggggtgacggtccagattaaggcagagctgacaccaaaggataacatctacaccagtgaagttgtgtcccagcgtggactagtggggtttgaaatcccctccatccccacgtcagcccagcacgtgtggctggaggttttccaggaactggaagattatgatgtttctgattcctttggcgtgtccagggaggatggtcctttttggtgggctgggctgacggcacaacgacgccggcgctcctctgtcttcccgtggccttggggcatcaccaaggactctgggtttgccttcaccgtaaggagaggaaacgggactggtggtgatgaccgaccgagtgagcctgaaccaccggcaggacggtggcctctacaccgatgaggctgtccccgctttccagccccacacagggagcctggtggcagtggctccttccaggcacccccccagaacagagaagagaaaaaggactttcttccccgaaacatggatttggcattgtctcaacatcaggtacattaagatttcttttctgcgctgactttgccggttgagtgaaagacactcatgcgggtccagagagcctccggtgagatgggcaggcctgataccaacatctgagcaagacactgtgcatctttttctaacacacaaaacttcaagccatgaagccagccttgagtcccgctgcacatttggacgtttgcctgtgaaatatgaaatgcaagggctttgtgcctcttataactccctcttggggttactctatctgctctgtttgtataacgagctcattaaaatgattacagttccctg

SEQ ID NO: 948 - DNA, 378 bp, Homo sapiens
ccctggggaagagaagctgagaggaactcctcactcagctagcttcaggagccatgacatcatctctaccatggaaattccactcactctcctgtgcccccacatttgtcctaggcctcagagtccctataaagagagattcccaactcagtatcagcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaaaggcaagcaagtctgcgctgaccccagtgagtcctgggtccaggagtacgtgtatgacctggaactga

SEQ ID NO: 949 - DNA, 4659 bp, Homo sapiens
agttgcttggaggagcttggagaaaccagaagtgagatccaggagaagtaaggccctggagtgccaggagcccttctcccaaagatggagaaataaatgaagaaatacaggaaaataagcattgggtgttttgcaatggctacacaaactagtcatgtcttccatggtcaagaaaatatgtttctggaaaaccattgcattaggagaaacactggcagagattcaaagaagccactaaagcagaagaatatgaatggacttgggcaaaattcggacaatggattattggttacacatgttaaccagacacaggacttactgaggctgcaggggagtgagacccagtcttcagattgggaggactctgaagactggctttcggctcacagtttaaaatgtcagaaactcaccttggctgacctgataagccagggcacagaagtgctggaggagggcaccaatgtcgtgcagaaaatatgtttctccacccagatcatccgccattttgagtcaaagctttctgacactattgaagtctatcaagagagaattcagtggctcacagaaaacagcaagaaggcatttggcctcatcaaaggggccagagtcagcatcctcatagatgtgtcagccatcagcagtggccctcagaaagaagagttccaaaaggacctcatgagcctcatcgatgagcagctgagccacaaggagaagctgtttgtcctgtcctttggcaccaatgccgggtccctctggccagaccccatggaagtcagcgcctccaccctccaggaacttaagctctgggtaaagacgctgcagcctgatggaggcagcaacctgctacaagctctgaagaagatcttcactctcaagggactggattccctggtggccatcatgagaagctgcccagatcagccttctgaaatcctgtctgactacatccagcagtccaccatgggaagagacctcatcatccacttcatcacctacagatgcgatgatcagatgccccctgctgtcctgaagaaccttgcagaagctgttaggggctactaccactgctacagcccaaagatggagcactacaccagccgggacatggatgagctcctggcagaaattcagaaggcccagagcctcctcagccacgtgcaagccctgcagcacagcagcccctgtgaggcgctcacctgcaccatggaggagatttccacagagattacaaatgggccactcataagcctcttgcctaaacccccaaagcatgacgctcctctcaccattgagtttccaaacttggacaagacttctgcagagtggcttaaggtcaatggtctgaaagccaagaaattaagtctatatcaggtcctggcacccaatgcattctctcctgtggaggaatttgtacctattctccagaaaacagtatcatcgaccatccatgagaaggcaatgatacaatttgaatggcacgacgggacagtgaagaacattcatgtggacccacccttcctctataagtaccagcaacagctcagcagagctatgcggatgtatgagaggcggattgagtggctctccctggccagcagaagaatctggggcacagtctgtgaaaaaagggtggttgtactgctcgatatctctgcgaccaattccatgtacattattcatatccagcactccctgcggctgctgctggaggagcagttatccaacaaggactgtttcaacctcatcgcgtttggaagcacaattgaaagctggaggcctgagatggttcccgtgagtcacaacaatttacaaagtgcctggcggtgggccctgaacctgcggtgtcggggcagcaggaacgttctcagcgccctgcggaaggctgtggaagtagacttcaaggacaaagacaaacaccaatcgcagggaatctacctcttcactgggggcatccccgaccaggacatgcctacactcagtgcctacatggctgaggcctgtggcggctgcgacctccagctgaacgtgtgtctcttctacgtgggcgagccaaagatggacaccacaccccctgcccgctatgccagtcacactgacacagccgccgcctacaaggaggtcacccgggctgcaggtggccgcttccactggtttggagacacaggcatttatgagagcgatgacatcaactccatcatgtctgagatggaaaaggctctcaactactcccaaaagtgtgccttcctcatggcctccctgaagaaccattcaggaaaagtactgggaagttcagccctcccgaaagaaaaaccaaagacacttcagctaagaagtcagcccaagaagctctgccctcccaggcccaccgtccccctgggggccagaatgagcattaaagatgaccctgacagagagaagagccccccgctgaaatctctgaaatggcgtccactcagtagcagagttggcatctcaccagctgcggcccagccaacgaaagaagggatgatggaactgaggaggaagaccaagtcaagggaagcagagacatctcttttactgttctacacagagaaagggaatgacgtgggctcagtgtacaagaagtaccctcaaggaaggggcttgagaaggactagctcttctattgacttacccagaaaggatacagtttgctcaagccaagagtgggtggcaaaatatgggctcaaaaaattgaagctggagatttccagatgcatgggtcccaactgcactcatcaaaagtcaggacagaggtcagcatccgccaaacactgcagcatcttccccagcgttgagatccatggagtggtgagacacatccagtggacgcccagggagatggaggtgtacatcaggcacttggagaaggtgttaaggcgctatgtccagaggctgcagtggctgctgtccggtccagtcctctgcagtaggacctggtatagacagtccatggacaggggcgtcatgatgactgctgcttcagggagccgccgactgtttggcaccgttttggagagcaaagtatgcatattgctggacacgtcagggtccatgggcccctacctgcagcaggtgaagacagagctggttttgctgatttgggaacagctgcggaagtgctgtgacagttttaacctgctcagctttgcagagagctttcagtcatggcaggacacgctggtggagaccacagatgcagcgtgtcatgaggctatgcaatgggtgacccacctgcaagctcagggcagcacctccatcttgcaagcattgctgaaagctttcagtttccatgatctggaaggattgtacctcctgaccgacggaaagccagacacaagctgcagccttgtcctaaatgaagtccaaaaactcagggagaaaagagatgtgaaagtgcacaccatttccttgaactgctcagacagagcggcggttgagttcctgagaaagctggcttccttcaccggcggacgctatcactgccctgtgggtgaggacacactctccaaaattcacagcctgctgaccaaaggcttcatcaatgaaaaggatcccacattgccaccatttgaaggagatgatttaaggatcctggcccaggagatcaccaaggccagaagcttcctctggcaggcccaatccttcagatcccaactccagaagaaaaatgatgcagaaccaaaggtcactctttcctagagaagtgttctcagaaaagtcatcctgcaaaggaccactcactgagcaaatctcagccccgagggcaggatgggatgaaatgctgtgacctgcaggaaacatgattcctggtaccaggactctctggaagctgaggaaggaaagactttgtcttttgtgtgaggggccattcccgggtcttaatctaactctccagccctgtcccgcagcgcactctactctccagccactagattgtccctctctgggaagccctaaaccaaccccctgcctaaatggtggtgcttcttgcaaaccaaccccctgcctgaacggtgcttcttgccccctctgcctggagactcctgctcatccatcaaggcacagctcaaatgacatcagctccctgggacctatctagagcgaggggcctccagtctttctcttgcagcatcctgaccacgcagacctctcgcactcagcactctatgtcacgccaccttgctcgctgatctaactcttctccttgatggtgagctccttcgggatgagactggtgtcccaggatctgcaggtccccagaagctgccacataggagacacatggtgaacagtgagcaggcggctgagctgtgagagcctagctctggaaagcagctgatggggtggtctccaccctggttcataagaggctaatgcagagtcacagtcagcccatcctgggggaagaagaaacaagtgagcctcagcaccaccctccatccctgcccaaccaaactgaagtgaaggctgctcatctgggttcattttctaaaattaaaaacaattaattttattctactaataggatcaacatgactttaactgtttgaagtgatcattggcgtgtgtgtgtgtgcataaatttttagtgacataaaactttattaaaagactcataccataataaagaatttc

SEQ ID NO: 950 - DNA, 4587 bp, Homo sapiens
agttgcttggaggagcttggagaaaccagaagtgagatccaggagaagtaaggccctggagtgccaggagcccttctcccaaagatggagaaataaatgaagaaatacaggaaaataagcattgggtgttttgcaatggctacacaaactagtcatgtcttccatggtcaagaaaatatgtttctggaaaaccattgcattaggagaaacactggcagagattcaaagaagccactaaagcagaagaatatgaatggacttgggcaaaattcggacaatggattattggttacacatgttaaccagacacaggacttactgaggctgcaggggagtgagacccagtcttcagattgggaggactctgaagactggctttcggctcacagtttaaaatgtcagaaactcaccttggctgacctgataagccagggcacagaagtgctggaggagggcaccaatgtcgtgcagaaaatatgtttctccacccagatcatccgccattttgagtcaaagctttctgacactattgaagtctatcaagagagaattcagtggctcacagaaaacagcaagaaggcatttggcctcatcaaaggggccagagtcagcatcctcatagatgtgtcagccatcagcagtggccctcagaaagaagagttccaaaaggacctcatgagcctcatcgatgagcagctgagccacaaggagaagctgtttgtcctgtcctttggcaccaatgccgggtccctctggccagaccccatggaagtcagcgcctccaccctccaggaacttaagctctgggtaaagacgctgcagcctgatggaggcagcaacctgctacaagctctgaagaagatcttcactctcaagggactggattccctggtggccatcatgagaagctgcccagatcagccttctgaaatcctgtctgactacatccagcagtccaccatgggaagagacctcatcatccacttcatcacctacagatgcgatgatcagatgccccctgctgtcctgaagaaccttgcagaagctgttaggggctactaccactgctacagcccaaagatggagcactacaccagccgggacatggatgagctcctggcagaaattcagaaggcccagagcctcctcagccacgtgcaagccctgcagcacagcagcccctgtgaggcgctcacctgcaccatggaggagatttccacagagattacaaatgggccactcataagcctcttgcctaaacccccaaagcatgacgctcctctcaccattgagtttccaaacttggacaagacttctgcagagtggcttaaggtcaatggtctgaaagccaagaaattaagtctatatcaggtcctggcacccaatgcattctctcctgtggaggaatttgtacctattctccagaaaacagtatcatcgaccatccatgagaaggcaatgatacaatttgaatggcacgacgggacagtgaagaacattcatgtggacccacccttcctctataagtaccagcaacagctcagcagagctatgcggatgtatgagaggcggattgagtggctctccctggccagcagaagaatctggggcacagtctgtgaaaaaagggtggttgtactgctcgatatctctgcgaccaattccatgtacattattcatatccagcactccctgcggctgctgctggaggagcagttatccaacaaggactgtttcaacctcatcgcgtttggaagcacaattgaaagctggaggcctgagatggttcccgtgagtcacaacaatttacaaagtgcctggcggtgggccctgaacctgcggtgtcggggcagcaggaacgttctcagcgccctgcggaaggctgtggaagtagacttcaaggacaaagacaaacaccaatcgcagggaatctacctcttcactgggggcatccccgaccaggacatgcctacactcagtgcctacatggctgaggcctgtggcggctgcgacctccagctgaacgtgtgtctcttctacgtgggcgagccaaagatggacaccacaccccctgcccgctatgccagtcacactgacacagccgccgcctacaaggaggtcacccgggctgcaggtggccgcttccactggtttggagacacaggcatttatgagagcgatgacatcaactccatcatgtctgagatggaaaaggctctcaactactcccaaaagtgtgccttcctcatggcctccctgaagaaccattcaggaaaagtactgggaagttcagccctcccgaaagaaaaaccaaagacacttcagctaagaagtcagcccaagaagctctgccctcccaggcccaccgtccccctgggggccagaatgagcattaaagatgaccctgacagagagaagagccccccgctgaaatctctgaaatggcgtccactcagtagcagagttggcatctcaccagctgcggcccagccaacgaaagaagggatgatggaactgaggaggaagaccaagtcaagggaagcagagacatctcttttactgttctacacagagaaagggaatgacgtgggctcagtgtacaagaagtaccctcaaggaaggggcttgagaaggactagctcttctattgacttacccagaaaggatacagtttgctcaagccaagagtgggtggcaaaatatgggctcaaaaaattgaagctggagatttccagatgcatgggtcccaactgcactcatcaaaagtcaggacagaggtcagcatccgccaaacactgcagcatcttccccagcgttgagatccatggagtggtgagacacatccagtggacgcccagggagatggaggtgtacatcaggcacttggagaaggtgttaaggcgctatgtccagaggctgcagtggctgctgtccgggagccgccgactgtttggcaccgttttggagagcaaagtatgcatattgctggacacgtcagggtccatgggcccctacctgcagcaggtgaagacagagctggttttgctgatttgggaacagctgcggaagtgctgtgacagttttaacctgctcagctttgcagagagctttcagtcatggcaggacacgctggtggagaccacagatgcagcgtgtcatgaggctatgcaatgggtgacccacctgcaagctcagggcagcacctccatcttgcaagcattgctgaaagctttcagtttccatgatctggaaggattgtacctcctgaccgacggaaagccagacacaagctgcagccttgtcctaaatgaagtccaaaaactcagggagaaaagagatgtgaaagtgcacaccatttccttgaactgctcagacagagcggcggttgagttcctgagaaagctggcttccttcaccggcggacgctatcactgccctgtgggtgaggacacactctccaaaattcacagcctgctgaccaaaggcttcatcaatgaaaaggatcccacattgccaccatttgaaggagatgatttaaggatcctggcccaggagatcaccaaggccagaagcttcctctggcaggcccaatccttcagatcccaactccagaagaaaaatgatgcagaaccaaaggtcactctttcctagagaagtgttctcagaaaagtcatcctgcaaaggaccactcactgagcaaatctcagccccgagggcaggatgggatgaaatgctgtgacctgcaggaaacatgattcctggtaccaggactctctggaagctgaggaaggaaagactttgtcttttgtgtgaggggccattcccgggtcttaatctaactctccagccctgtcccgcagcgcactctactctccagccactagattgtccctctctgggaagccctaaaccaaccccctgcctaaatggtggtgcttcttgcaaaccaaccccctgcctgaacggtgcttcttgccccctctgcctggagactcctgctcatccatcaaggcacagctcaaatgacatcagctccctgggacctatctagagcgaggggcctccagtctttctcttgcagcatcctgaccacgcagacctctcgcactcagcactctatgtcacgccaccttgctcgctgatctaactcttctccttgatggtgagctccttcgggatgagactggtgtcccaggatctgcaggtccccagaagctgccacataggagacacatggtgaacagtgagcaggcggctgagctgtgagagcctagctctggaaagcagctgatggggtggtctccaccctggttcataagaggctaatgcagagtcacagtcagcccatcctgggggaagaagaaacaagtgagcctcagcaccaccctccatccctgcccaaccaaactgaagtgaaggctgctcatctgggttcattttctaaaattaaaaacaattaattttattctactaataggatcaacatgactttaactgtttgaagtgatcattggcgtgtgtgtgtgtgcataaatttttagtgacataaaactttattaaaagactcataccataataaagaatttc

SEQ ID NO: 951 - DNA, 1295 bp, Homo sapiens
gcgcagcagccaggagcgcccacggagctggacccccagagccgcgcggcgccgcagcaggtgggtgacaccccgccccggccggccggagacccgagcccatcgccgtcagccagccagggccgcgcgggttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccggtgatcttgatagtggacaaagtgctcgagacccaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgcctggtcccagtaggtatcaggtctttctgtgcagctcagggagaccctaagttaaggggcagattaccaataaagaactgaatgaattcatccccccggccacctctctacccgtccagcctgcccagaccctctcagagg

SEQ ID NO: 952 - DNA, 4910 bp, Homo sapiens
ctccctccctctctccccagctgcctcctcctcttctctccccgctctccttcccctttcaccccatcccctgccctggctgcaaccatgagggtcttggcctgcctccttgcggccctggtggggatccaggctgttgagcgcctgcgcctggccgatggcccccatgggtgcgctggccgcctggaggtctggcatggcgggcgctggggcaccgtgtgtgatgacggctgggacctgcgcgatgccgccgtggcctgccggcagctgggctgcggaggggcactggccgccccgggaggcgccttcttcggggagggggcagggcctgtgtggctcagcgagctggcttgccggggcaacgaggggcagctgggcctctgccaccaccggggctggaaggcccacatctgctcccacgaggaggacgcgggcgtcgtctgcgcaggtcagcgtgtggctaactccagggacgactcaacatctcccctggatggggctccctggccagggctgttgctggagctgagccccagcacggaggagcccctggtgacacatgccccccgcccagctgggaacccccagaacgcctcccggaagaagagcccccggcccaagcaggccaagtccacccgggcccctctgctgacgacaggagccccccgccaagagcggctgcgcctggtctctggcccccacaggtgcgccggacgcctggaggtctggcacggcgggcgctggggcaccgtatgtgacgatggctgggacctgcgcgacgctgctgtagcctgccgggaactgggctgtgggggggcgctggctgcccccggcggtgccagattcgggcctggtgcagggcccgtgtggatggacgatgtggggtgtggaggaggagaacaggccctccgagactgcccccgaagcccctggggccggagcaactgtgaccacagcgaggatgcggggctggtctgcaccggcccagcacctcggctgcgcctggccgatggcccccacgggtgcgccggccgcctggaggtctggcacgggggtcgctgggggtcggtgtgtgacgacgcctgggacctgcgagacgccgctgtggcctgccgagagctgggctgcggaggggcgctggccgcccccgggggcgccttctttggggaggggtctggacccatcatcctggacgaccttcggtgtcggggaaacgagacggccttacgattctgcccagctcggccctggggccagcatgactgtcaccaccgcgaggacgccggggccgtgtgtgacggcatgcccctgggctacgtccctcccacggcccccacggacagcaacaactccacgcccagggaggctgcctccaggcccccgtccaccatgacgagccaggctccagggacggcaggcgtttcacctcctccagcctcccctactgtcctttgggagcctggaccggaagccgggtccccccagctgcgcctggtggctgggcccagcaagtgctcaggtcgactggaggtgtggcatgaccagcgctgggggaccgtgtgtgacgatagctgggacatgcgggattcagctgtggtctgccgggagctgggctgtggtggacctcagcagccagaccctgctgctggccgctttggctggggtgcgggccccatctggctagatgatgtgggctgtgtggggaccgaggcttcactgtccgactgccctgctgctccctggggaaagcacaactgcgctcacaatgaggatgttggggtcacctgcactgggcccccaggcctggactccatctcagaccccttcagctggagctggattcctggactggggagagatcgggatgcctggctcccgggagagctggccaccaagccctctgcaagtgtgactgccagtgttctggagaaaacaaccacgaaggccccagggaaaatgcctaagagtactaagaagtgggtgacaaaaaatgcaaagagaccaaccactcaacccccagtgatgccaaccacgaaacactccagggcccaaagccccccagacctaacctcacagaccactgcagcactgaccactgaggcctcccgaagacctacctctgagtttaccagaaggccgaccacggaggccccccagagatggacctctcacaccactgccacgctgacccctcaggccccccgagaacggaccactaagaccatggcaatgctgaccactcaaggcccccaagaaatgacctctgagtccactatcaagagtatccctcaggcctccctggagccatctgctgagatcccagaagggtctccagagtcacccaaagacccggccccctctcccagtgttagcaccactggggaatcaggcctgttccgggttcgtctggccgatgggcccaaccgctgtgctggccggctggaagtgtggcatgccggacgctggggaacagtgtgtgatgacaactgggacctgcgggacgccactgtggcctgctgggaactgggctgtggaaaggtccggcctcgagtaggcaaaacccattacggccctgggactgggcccatctggctggatgacatgggctgtaagggaagcgaggcctcactgagcgactgcccctcgggggcttgggggaagcacaactgtgaccacgaggaagacgtggggctcacctgcactggctacacagactatgacgattatcccccctggacctgggaccccacctcaagagaggacctggccaaggggactaccacagcgggggtacctggacacactctcccctggaggaccacccggcgcccgggtagctcctccccagcaataaggcgcctgccggacacaggcagcaaagatggttacaagcttccctggacgtgggacacaccatcaggaaggggcctggctgaggggacccctaccgcaggcaaactaggaccaactcttggggctggcaccaccaggagcccaggcagtcctccaactctgagagtccatggagacacaggttccccgaggaaaccgtggcccgagcgccggccaccgcggcccgctgcgaccaggacagcgcccccaaccccgtccccaggtccctccgcctctccgggacccccaggcccagcgctgacctctgactccagtcgagagctcactccccactcagccttgacgtccgaggcgacctctgacgctccggacacttcaccacccaccccagacccggcctcccggacgaaccccgacctcatcttgacaagccctgactttgctttgtccacccctgactccagtgtggttcccgcgttgaccccggagccctcacccacgcccttacccaccttgcccaaagagctgacctctgacccttctacaccgtcggaggtgaccagcctttcccctacctcagagcaggtcccagaatctgacacaaccccagatttggacacaactccatactccagtacagtctcagaatattctagatccccagacccctccccaagccctcaccccactactacccctgatcccaccatggcccctgaccccatcacaacccttaaccctactgtgacccctcacttccctaccacccctcaccccaccacgacccctcaccccaccaccatcactcactccaccatgattcctgaccccaccacaacccctcaacccttcaccaccatcactcactccaccatgattcctgaccccaccacaacccctcaacccttcaccaccatgcagcccaccacaacccctcactccacaacccctcaccccaccacgacccctcatcccaccaccatcactcactccaccatgattcctgaccccaccacaacccctcaacccttcaccaccatgcagcccaccacgatgcctcatcccaccacgacccctcaccccaccacgactcctcaccccaccacaacccctcaccccaccacaacccctcaccccaccatgactcctgaccccaccacgaccccttaccccaccactactcctgatcccaccacgacccctcaccccacaactcctgacccttcctcaacccctgtcatcactactgtgtcccttccaacctccttggggacagaactctcctctcccactctagcaccaacagtcaagcccagtctgcacccccagttgaccttcacagcacctgcccctcacacctccacatcccagatacccaccttagagccctctccagccttggagtccagcccctccaggtcctccacagccacaagcatggacccactgtccactgaggacttcaagccacccagaagccagagccccaacctaacccctccacccacccataccccacactcagcctctgaccttactgtgtcccctgaccccctcctttcccccacagcccaccccttggatcatcctccccttgaccccctcaccctagggccaactcctggtcagagcccaggcccccatggtccatgtgtggccccaacaccacctgtaagggtcatggcttgtgagccacctgccctggtggagctggtggctgctgtgagggatgtgggtggtcagctgcagagactgacccaggtcgtggaacaggagcggcaggagcgccaagccctgctgctggggctgacgcagctggtagaagctgcccggggtctggggcagctgggtgaggctgtgaagagactggcagagatggcctggaccaccagcatgcctgcaccaaccaccactaccccagaggaagaagaaagacccctgaggggagacgtgtgaccctctccaggatttgaggggcttaagacacccccaaccaaaaaaaacaaaaacaaaaaaaacccccaaagtatctaattaaaaacaaggtgtgaatggta

SEQ ID NO: 953 - DNA, 3292 bp, Homo sapiens
atgaccacgtggagcctccggcggaggccggcccgcacgctgggactcctgctgctggtcgtcttgggcttcctggtgctccgcaggctggactggagcaccctggtccctctgcggctccgccatcgacagctggggctgcaggccaagggctggaacttcatgctggaggattccaccttctggatcttcgggggctccatccactatttccgtgtgcccagggagtactggagggaccgcctgctgaagatgaaggcctgtggcttgaacaccctcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttggccaccatcaacttgcagtcaacacacgagctgcagctactgaccacctttctcttcaacgtccaggggactcagcccaagatggtgatggagtactggacggggtggtttgactcgtggggaggccctcacaatatcttggattcttctgaggttttgaaaaccgtgtctgccattgtggacgccggctcctccatcaacctctacatgttccacggaggcaccaactttggcttcatgaatggagccatgcacttccatgactacaagtcagatgtcaccagctatgactatgatgctgtgctgacagaagccggcgattacacggccaagtacatgaagcttcgagacttcttcggctccatctcaggcatccctctccctcccccacctgaccttcttcccaagatgccgtatgagcccttaacgccagtcttgtacctgtctctgtgggacgccctcaagtacctgggggagccaatcaagtctgaaaagcccatcaacatggagaacctgccagtcaatgggggaaatggacagtccttcgggtacattctctatgagaccagcatcacctcgtctggcatcctcagtggccacgtgcatgatcgggggcaggtgtttgtgaacacagtatccataggattcttggactacaagacaacgaagattgctgtccccctgatccagggttacaccgtgctgaggatcttggtggagaatcgtgggcgagtcaactatggggagaatattgatgaccagcgcaaaggcttaattggaaatctctatctgaatgattcacccctgaaaaacttcagaatctatagcctggatatgaagaagagcttctttcagaggttcggcctggacaaatggagttccctcccagaaacacccacattacctgctttcttcttgggtagcttgtccatcagctccaccccttgtgacacctttctgaagctggagggctgggagaagggggttgtattcatcaatggccagaaccttggacgttactggaacattggaccccagaagacgctttacctcccaggtccctggttgagcagcggaatcaaccaggtcatcgtttttgaggagacgatggcgggccctgcattacagttcacggaaaccccccacctgggcaggaaccagtacattaagtgagcggtggcaccccctcctgctggtgccagtgggagactgccgcctcctcttgacctgaagcctggtggctgctgccccacccctcactgcaaaagcatctccttaagtagcaacctcagggactgggggctacagtctgcccctgtctcagctcaaaaccctaagcctgcagggaaaggtgggatggctctgggcctggctttgttgatgatggctttcctacagccctgctcttgtgccgaggctgtcgggctgtctctagggtgggagcagctaatcagatcgcccagcctttggccctcagaaaaagtgctgaaacgtgcccttgcactggacgtcacagccctgcgagcatctgctggactcaggcgtgctctttgctggttcctgggaggcttggccacatccctcatggccccattttatccccgaaatcctgggtgtgtcaccagtgtagagggtggggaaggggtgtctcacctgagctgactttgttcttccttcacaaccttctgagccttctttgggattctggaaggaactcggcgtgagaaacatgtgacttcccctttcccttcccactcgctgcttcccacagggtgacaggctgggctggagaaacagaaatcctcaccctgcgtcttcccaagttagcaggtgtctctggtgttcagtgaggaggacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatagctgtgtatgagctggttccgtcagaaagtgatggaatggaagggaaccttcctgcaaatcctcctgtaaggtggagaagccccttggatcacacttccacgcagacctgagcaggacacactgtggtttcctaagcccccgccccgtcagttgagcccgatggccttcctgctgatctgtaagcaggctgagcaacgcttgttccgcctggtggagagttcgttcttcttgggcccggggagctgcatgtcagggtgttgctgcttcgctcaagggtcacttatcacggaggcctctgtggtcaccctacagagcactgaccctctccactgctacctctgtctccccgactcaccctcatcctccatacaacagattgcatctgaaataatatgcattcgttattgcctgtc

SEQ ID NO: 954 - DNA, 2770 bp, Homo sapiens
aattcagcactaaaaccagtgtgagaagcagtatgtgtgagcatgtgtgtgtgtgtatgtgtgtgggggggggtgtaaaatgtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatgacatgc

SEQ ID NO: 955 - DNA, 523 bp, Homo sapiens
gaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgcacctgt

SEQ ID NO: 956 - DNA, 538 bp, Homo sapiens
tttggctcttgatttacattgggtactttcacaacccactgctcatgaaatttgcttttgtactcactggttgtttttgcataggcccctccaggccacgaccagctgtttggattttataaacgggccgtttgcattgtgaactgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcct

SEQ ID NO: 957 - DNA, 1110 bp, Homo sapiens
gcttccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctctgggtaaatgagtgccagggccggcaagcccccgctccccgggctctcggggtcgcgcgaggatgcttggcacgtaccccgtgtacatacttcccgggcgcccagcatggaaataaagcacccagcgctgccctggg

SEQ ID NO: 958 - DNA, 1132 bp, Homo sapiens
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatctccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtctacatacttcccgggcacccagcatggaaataaagcacccagcgctgccctgggcccctgcgagactgtgatggttctt

SEQ ID NO: 959 - DNA, 1128 bp, Homo sapiens
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtgtacatacttcccaggcacccagcatggaaataaagcacccagcgcttccctgggcccctgcga

SEQ ID NO: 960 - DNA, 2004 bp, Homo sapiens
caggcagcaggcagcaggcgggcgcgctgtggctccgcgccgcgcggtccgggctctgttcattcatgattggtactcggccctccgagacccagcccgagcgcagggaggggagccgagtgtgcggcaggaggggcgggcggacggcggctcccgcaccgcacgcggcgctggctcggcagcctcggccgggcggccgctctggccccgtgtccagtgccaggcaggcttcagggcaccgtcctcggccctgggcgagggaaccgccgggccgggtcctcgcgcggggaagcggttccgaaggctcgcggggagcggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctc

SEQ ID NO: 961 - DNA, 1927 bp, Homo sapiens
ggagagggtgatgctggctccaagcctgactctgctctcgagagctccagcaggagaggcccttcctcgcctggcagcccctgagcggctcagcagggcaccatggcaagatcccttctcctgcccctgcagatcttactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcatggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtggggaaaaaagtctgaaga

SEQ ID NO: 962 - DNA, 520 bp, Homo sapiens
cacaccaaggatggagatgttccagaggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtccatcccgtctcccggggccctaggacaccccgatcctcccacaataaaggcttctcaat

SEQ ID NO: 963 - DNA, 2906 bp, Homo sapiens
cccgggcagccgaccagccccacgccggccccgggcgtccgtcgttcggtcccgcgatccgtccgacggtccacccagtgcttgcggcctcgcggccgggccggcctgggctgcaatcaatgcggctttgtctgggacgcccacatcccagaggccattcccgggtcggcaaatcggagcgcggccggggcgcgcgggggtgagataagcggccatgtgatcccacctgggctggaaggggaggggcgccaggtgaggcggcggccggcggggcgcgggcggccacgcggggctcctgcagcatggctgtcagcaggaaggactggtccgcgctgtccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaggtgtaagagactgatgagaccttagaagcgaattcctctctggaggccttgctttctagcagaggtcacctgaagtgtgtgaggaggatcatcattttcctcatcccccctcttctcacattaaggtggtggcttgccactcagcagtcctagcttggtgactgggaactgccacatacagggccaggcctaccctccttccccacaagccccctccaacccccacccccatgctctggacctcatggctcctatgagcttggagcatggtgaaccatcagagaatctagaaccaaccaagctaggaacatcagcctggtgccctgttaaccccttaaagctgtggtttacaacttttcaaaaatttaaatcattagaa

SEQ ID NO: 964 - DNA, 642 bp, Homo sapiens
cagcgtggacttgccagaagcctccctggcagccgagggcccttctataaagaggactcttgagctggcagcagagcccatccaggcagcacggctggctgagcagagacaagggctgcccacactgggactggtagaggaagccggccctgacggatgggtggtctcgcccttcctgggttcatcctgctgcaggtgggcctgagtcgcagatcaggaagcaccgggaagatgcaggcctgcatggtgccggggctggccctctgcctcctactggggcctcttgcaggggccaagcctgtgcaggaggaaggagacccttacgcggagctgccggccatgccctactggcctttctccacctctgacttctggaactatgtgcagcacttccaggccctgggggcctacccccagatcgaggacatggcccgaaccttctttgcccacttccccctggggagcacgctgggcttccacgttccctatcaggaggactgaatggtgtccagcctggtgcccgcccaccccgccaggctgcactcggtcgggcctccacaggcatggagtccccgcaaaaacctggcccctgcaggagtcaggcctggtctcacgctcaataaactccggactgaagatgca

SEQ ID NO: 965 - DNA, 2499 bp, Homo sapiens
gatgacagcgccactgacccgcgggcggccggcgagccgcggcagattccggggtcggccccggcagacaggctgcggggctcgactctgcgggagcgcctaaggcattggcaatctggggctcaggctgtgcagttctgggtcctcggccgcccacaggcgtcggcgaaaggctgccgccccggccggggaccaggaagcgtcaggcagctggcaagggctccccggggacgcgccacagcctcacagccggcccgagtctcctgggaggcagggctggaagggcaggggtgaaggccagctgtggccgcttgggaaggaccgcctcgcctgctcccgacctaagtcagaacacctggatgaccggtgcctccaggacgcaggtgcaggtgagactcgccctgccacagcaccctgcatctccgcggaggccctcgggagcccagcgtgtctgctcaaaacgaggaaagaatggttaaagcccgaatcgcgactcttaatcccagcgggacagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcc

SEQ ID NO: 966 - DNA, 2574 bp, Homo sapiens
gacatcatcagtccgcgccggcgtaacggcccgcggtatctcagcaaccgctgggcatccggaggatgtggggacgcggagctgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggaggaatccgacacgtgacggtctgtccgccgtctcagactagaggagcgctgtaaacgccatggctcccaagaagctgtcctgccttcgttccctgctgctgccgctcagcctgacgctactgctgccccaggcagacactcggtcgttcgtagtggataggggtcatgaccggtttctcctagacggggccccgttccgctatgtgtctggcagcctgcactactttcgggtaccgcgggtgctttgggccgaccggcttttgaagatgcgatggagcggcctcaacgccatacagttttatgtgccctggaactaccacgagccacagcctggggtctataactttaatggcagccgggacctcattgcctttctgaatgaggcagctctagcgaacctgttggtcatactgagaccaggaccttacatctgtgcagagtgggagatggggggtctcccatcctggttgcttcgaaaacctgaaattcatctaagaacctcagatccagacttccttgccgcagtggactcctggttcaaggtcttgctgcccaagatatatccatggctttatcacaatgggggcaacatcattagcattcaggtggagaatgaatatggtagctacagagcctgtgacttcagctacatgaggcacttggctgggctcttccgtgcactgctaggagaaaagatcttgctcttcaccacagatgggcctgaaggactcaagtgtggctccctccggggactctataccactgtagattttggcccagctgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttggatattggaatggtgccgataagaagggacgcttccttccgattactaccagctatgactatgatgcacctatatctgaagcaggggaccccacacctaagctttttgctcttcgagatgtcatcagcaagttccaggaagttcctttgggacctttacctcccccgagccccaagatgatgcttggacctgtgactctgcacctggttgggcatttactggctttcctagacttgctttgcccccgtgggcccattcattcaatcttgccaatgacctttgaggctgtcaagcaggaccatggcttcatgttgtaccgaacctatatgacccataccatttttgagccaacaccattctgggtgccaaataatggagtccatgaccgtgcctatgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccgggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctcaaaaaaaaaaaa

SEQ ID NO: 967 - DNA, 1862 bp, Homo sapiens
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgaggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcggagcaaaagtgaggggcaccacaggcgaacaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttccct

SEQ ID NO: 968 - DNA, 2704 bp, Homo sapiens
ctttgtttccactgggacggaatcggagctctggaggctgggctggccaagcgccccgaaggcccgatgcctgacggctcatgcggcctccttgtttgcagggcctgggcaaaaatttacactgagtcccactcttcgctccagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 969 - DNA, 2575 bp, Homo sapiens
gtgttgagtgcatcagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagc

SEQ ID NO: 970 - DNA, 1724 bp, Homo sapiens
ctttcacaaaaggtgaaatgagctctttgtagtgtttcccgcccaggctgcattttagaatcacagaggaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 971 - DNA, 1547 bp, Homo sapiens
atcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtaca

SEQ ID NO: 972 - DNA, 610 bp, Homo sapiens
agcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaagatcgctgcagtgaatgcttttaacctgtcaactgtgatgaaacaaacagaaaaccgaagccctggcttcttctgaggtgcaaataaatgaccgagaaggtgttatctaagacctctacagccatttgtatctggccgtgtgtagagtgggctctgcaagaccctgcctcactt

SEQ ID NO: 973 - DNA, 610 bp, Homo sapiens; identical to SEQ ID NO: 972

SEQ ID NO: 974 - DNA, 1547 bp, Homo sapiens; identical to SEQ ID NO: 971

SEQ ID NO: 975 - DNA, 2794 bp, Homo sapiens
ggccgatgccgctttaaaaaacgcgaggggctctatgcacctccctggcggtagttcctccgacctcagccgggtcgggtcgtgccgccctctcccaggagagacaaacaggtgtcccacgtggcagccgcgccccgggcgcccctcctgtgatcccgtagcgccccctggcccgagccgcgcccgggtctgtgagtagagccgcccgggcaccgagcgctggtcgccgctctccttccgttatatcaacatgccccctttcctgttgctggaagccgtctgtgttttcctgttttccagagtgcccccatctctccctctccaggaagtccatgtaagcaaagaaaccatcgggaagatttcagctgccagcaaaatgatgtggtgctcggctgcagtggacatcatgtttctgttagatgggtctaacagcgtcgggaaagggagctttgaaaggtccaagcactttgccatcacagtctgtgacggtctggacatcagccccgagagggtcagagtgggagcattccagttcagttccactcctcatctggaattccccttggattcattttcaacccaacaggaagtgaaggcaagaatcaagaggatggttttcaaaggagggcgcacggagacggaacttgctctgaaataccttctgcacagagggttgcctggaggcagaaatgcttctgtgccccagatcctcatcatcgtcactgatgggaagtcccagggggatgtggcactgccatccaagcagctgaaggaaaggggtgtcactgtgtttgctgtgggggtcaggtttcccaggtgggaggagctgcatgcactggccagcgagcctagagggcagcacgtgctgttggctgagcaggtggaggatgccaccaacggcctcttcagcaccctcagcagctcggccatctgctccagcgccacgccagactgcagggtcgaggctcacccctgtgagcacaggacgctggagatggtccgggagttcgctggcaatgccccatgctggagaggatcgcggcggacccttgcggtgctggctgcacactgtcccttctacagctggaagagagtgttcctaacccaccctgccacctgctacaggaccacctgcccaggcccctgtgactcgcagccctgccagaatggaggcacatgtgttccagaaggactggacggctaccagtgcctctgcccgctggcctttggaggggaggctaactgtgccctgaagctgagcctggaatgcagggtcgacctcctcttcctgctggacagctctgcgggcaccactctggacggcttcctgcgggccaaagtcttcgtgaagcggtttgtgcgggccgtgctgagcgaggactctcgggcccgagtgggtgtggccacatacagcagggagctgctggtggcggtgcctgtgggggagtaccaggatgtgcctgacctggtctggagcctcgatggcattcccttccgtggtggccccaccctgacgggcagtgccttgcggcaggcggcagagcgtggcttcgggagcgccaccaggacaggccaggaccggccacgtagagtggtggttttgctcactgagtcacactccgaggatgaggttgcgggcccagcgcgtcacgcaagggcgcgagagctgctcctgctgggtgtaggcagtgaggccgtgcgggcagagctggaggagatcacaggcagcccaaagcatgtgatggtctactcggatcctcaggatctgttcaaccaaatccctgagctgcaggggaagctgtgcagccggcagcggccagggtgccggacacaagccctggacctcgtcttcatgttggacacctctgcctcagtagggcccgagaattttgctcagatgcagagctttgtgagaagctgtgccctccagtttgaggtgaaccctgacgtgacacaggtcggcctggtggtgtatggcagccaggtgcagactgccttcgggctggacaccaaacccacccgggctgcgatgctgcgggccattagccaggccccctacctaggtggggtgggctcagccggcaccgccctgctgcacatctatgacaaagtgatgaccgtccagaggggtgcccggcctggtgtccccaaagctgtggtggtgctcacaggcgggagaggcgcagaggatgcagccgttcctgcccagaagctgaggaacaatggcatctctgtcttggtcgtgggcgtggggcctgtcctaagtgagggtctgcggaggcttgcaggtccccgggattccctgatccacgtggcagcttacgccgacctgcggtaccaccaggacgtgctcattgagtggctgtgtggagaagccaagcagccagtcaacctctgcaaacccagcccgtgcatgaatgagggcagctgcgtcctgcagaatgggagctaccgctgcaagtgtcgggatggctgggagggcccccactgcgagaaccgattcttgagacgcccctgaggcacatggctcccgtgcaggagggcagcagccgtacccctcccagcaactacagagaaggcctgggcactgaaatggtgcctaccttctggaatgtctgtgccccaggtccttagaatgtctgcttcccgccgtggccaggaccactattctcactgagggaggaggatgtcccaactgcagccatgctgcttagagacaagaaagcagctgatgtcacccacaaacgatgttgttgaaaagttttgatgtgtaagtaaatacccactttctgta

SEQ ID NO: 976 - DNA, 1010 bp, Homo sapiens
gttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggagaagatgggctcctgcaggttccatggaagctga

SEQ ID NO: 977 - DNA, 2831 bp, Homo sapiens
atggagcacagcgtctgccccagttcagcagtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatact

SEQ ID NO: 978 - DNA, 3160 bp, Homo sapiens
ccgagccgggcgcgcagcgacggagctggggccggcctgggaccatgggcgtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactata

SEQ ID NO: 979 - DNA, 1444 bp, Homo sapiens
atgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggc

SEQ ID NO: 980 - DNA, 1641 bp, Homo sapiens
atggctcagtggcactgctcacagagaacacaggctggaggacatggagtcggggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccac

SEQ ID NO: 981 - DNA, 2654 bp, Homo sapiens
tgcgagcttgagcggcgcgaggagatgctagagggcgcagcgccgccagcaccatgcgccccccgcccgcgctggccctggccgggctctgcctgctggcgctgcccgccgccgccgcctcctacttcggcctgaccgggcgggaagtcctgacgcccttcccaggattgggcactgcggcagccccggcacagggcggggcccacctgaagcagtgtgacctgctgaagctgtcccggcggcagaagcagctctgccggagggagcccggcctggctgagaccctgagggatgctgcgcacctcggcctgcttgagtgccagtttcagttccggcatgagcgctggaactgtagcctggagggcaggatgggcctgctcaagagaggcttcaaagagacagctttcctgtacgcggtgtcctctgccgccctcacccacaccctggcccgggcctgcagcgctgggcgcatggagcgctgcacctgtgatgactctccggggctggagagccggcaggcctggcagtggggcgtgtgcggtgacaacctcaagtacagcaccaagtttctgagcaacttcctggggtccaagagaggaaacaaggacctgcgggcacgggcagacgcccacaatacccacgtgggcatcaaggctgtgaagagtggcctcaggaccacgtgtaagtgccatggcgtatcaggctcctgtgccgtgcgcacctgctggaagcagctctccccgttccgtgagacgggccaggtgctgaaactgcgctatgactcggctgtcaaggtgtccagtgccaccaatgaggccttgggccgcctagagctgtgggcccctgccaggcagggcagcctcaccaaaggcctggccccaaggtctggggacctggtgtacatggaggactcacccagcttctgccggcccagcaagtactcacctggcacagcaggttggagtgcagtggcaagatctcagctcatcacaacctccacctcccggattcaagcgattctcccgtctcagctgcctgagtaactgggattacaggcatgcaccaccacgcctgactaattttgtatttttggctaattttgtatttttagtagagatgaggtttctccatgttggtcaggctggtctcgaactcccgacctcaggtgatccacccgcctcggcctcccaaagtgctgggattaccggtgtgagccactgcgcctggccagcatttttttttttgagacagagtctcgctctgtcacccaggctggagtgcactggcatgatctctgctcactgcaacctccacctcccaggttcaagtgactctcttggctcagcctcccaagtagctgggactacaggcgtgcaccaccacgctcagctaatttttgtattttcagtagagatggacttttatcatgttggccaggctggtctcgaactcctggtctcaagtgatctgccagcctcagtctcccagggtgctgggattacaggtatgagccactgtgcccggccgccttagcattttgtgtatgttttgagtgacagccatctgtcaatattggcatcttttgttttattggatgaatgaatgaacaaatgaatttataaatcttgttctccatactgtttacccatcctcatttccctcacttggcagtgtcttgccatagcaggcttcctggtgtagctggcaccacatccctccctgacacacggcctccttattgcccctgctacttgcctttttctctcctccctttccttcccttcattccccctggcttccccttcccaactctcagaatccctggctgcctcaaccacaagaacaaagctgtgcagaagcctgaacctggagcttctgcaagatgaggtggggaatgagctaacccagctggaaagcagcctgctgatccctgggagagacggcgcttgggccaacccaccctccccaaggtggtcccctgcctcagctccacccgcttccccagatgaacttctttctctccctccagcgcttcagaggatgcacagctgtgtgtacttgaccctgagcctgggctagtgctggggacatagccagtctggctgatacccatatcagtacagaaagctgtcctcacccacttcatgcactagttgcattggtatgaagcattagctttataactatcccatttactgcaggcataaacctatatcaattggtggggatggaggttaaatgagagaagacatcaaagatgcatagaactattgggcccctttcaattaataaataaaatttgtaggaggccattagtttgtactgtgctcctgtaatggacccaacagaccaaacaaatatggagtcactcatgctaaatgcaattaacttgggagtatactcctaagttgcaaaaagtggtaacaaatagctgagttttggggcagttacagcagctgagcatctgtcaatgtaggtggccaggtgattcaattaaggatgctgtaaccaattaagctgtatctacacctcacttctgttttctatctacaaatactgcgtgatcatgttgctggttggagttctttgaataagctgtggttcggagggatgcccaattctagaatcatgaataaaagcctattaagatcttt

SEQ ID NO: 982 - DNA, 1041 bp, Homo sapiens
ctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacagtgcacttgccggcggtcccaacccagcaggagaagtggacatgaggttggcaggtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggg

SEQ ID NO: 983 - DNA, 5345 bp, Homo sapiens
aatatgctcgttccattccctgctggctttgtggccacaaatggaggggcagctacgtttcttgaacacagagcctgagaggccttgtatgcagctgctggaagcagccaggagaccccaaaagtgggctggagacttcaacaaggacagggaacagggctgcactgagaggcccaggggctaggtcagcagcaccgctaggcagatttggaggggagctggggagaggcgaggcagccagctttgcaagattcccacggcacacagccagtgctcaggggttcccttctcagcgttcctctcacctggtgtggctccctcacgcttggcatggatctgagctcctttccttatggctgagacccaaactgcctacaagtggccttttctccctgttcttgcctgcaagggcagcatggggcctcaggctgtcagtgctaccagggacgctggcattcactttgtccataatgtacagatggatgtagacaactgccctcagggctgtccgggggcaggaccaagcccagcaaccacacctcctgacacagccaggttctcccccaacggcggagctgacaggactgttcatggttcattgagtggacccagcaatacctcatcgataatccacagtcgagagaagaggggcggtcagagaccggccagccctcccttctgattgggagaggcctctgcaggcactgacaggctccagagagtgctgtggggggcagtcagtgtccatagtcccctggaatcttctctgggctgttttctctgacttttcacctgaaattaactgtacatagctgggctaggaactctctaaatctgaaagcatgtggcttagggaaaatcacttgactcgtttaccttctggctaagaagtgaagactctgggctaatctagtcctccaggccctggagtcccacacagtgatgctatctgtgcagctagagggcagagcccttggtcatgtccaccctctgattaagtgggcatctcctctcctgctagctttggggcttggggtggggctgggacaaagcctggtgcccgtgtgattcatccgcacattatttctcctctctgccattctagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatgatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacgagactgggggaccggccgggcctggcaccaatctgcgctgcggtcgggcggagcttctgtttctcccagccaatcatgtgactcaaggaaaacttccggcgctgtgtccagtctcctccaatcaatggccttcgggggcgggccagcggccgctcaatccccactccctcatgctttgggttagggttttctttcacgctttctgaggaggagagcatggcgcgggcctcggcgaagcacttccgtcagcctcgggcggaggatcgtcttagtagctggccagacctggaggagagcgggcggtctttgcgggcctcaggagataggtggccgcccggcccctttccccgcctgcccggataggtgcgtgcagacccaccaaagaaaagcggtcgctgcgggacccccagtcccacctcggccgcgctgtgggatggctgcgcccccagggcttcctgcgtctccaggaagccgggagtggcgccctctgcggggtggggtgctcccgggccgaactccggacaggtggaggggacagggcagagctcgaggaagccctgtccccttcagtgcaaggtgctgtcactcacgtgtgccctcgaccctcccgttcacccgcagccttctcagcgcctctccctgggccggaggcctcctcaccagcctacctgttgctctggaaaaaaatcccgtcccccgactccgtccctacccccagtcttcggccggctctggcccctggggagggggctgcacggcggaaggaggctggctatgggcccggctgcccgctgcatgtacctcctcctccacccatcgcctcttgcctgggggtaactttgcctggggctcattctttggttaagctgaagctgccgtgggtggccaaaccgcagattctttgcaaattctgagctggcagagctcgcagccgggagccggccggggaagaggagacttgcgcgccgcaagccgcctgcctccaccctgctctccatctcccgctctagaagggctgggaagctcgcggccggggttccacctggaagctgcttgcatggctgaacccagcttaggtccctgacggggctgctggtggaattctcccccttcgaagctggggaggtttaggagggggaaggcttctgtgaagctctcaaaccactaatagagccccctccccaacagtgacggcgcagatgctcccccttttcttagttgacaccaccaggcagcttcctggccgttggtaggttcctgcagctggctgagggaacagggaccggcaggggactttgttaggggagggttgggatgggcagtgggcccctgaaagttaatatattggaacctagctcgagtgtcgttctttccaattccgaaagtagaaagagtaaaaataggggtgattggggtggggttagtagaatgcctctctcagggcgctcccccctcccccaccgttttagagagctaggcctcagccagtcttgccactcccatctcagtgcttcctgaagaggctgttttgagtgttgatgaaaagcaatgcaattatgccaaacagtattgagcagaataatttatttcttttttttcttttgctttaaatcatgaatcccgccaggtacggtggctcacacctgtcatcccagcactttgggaggccaaggcgggcggattacttaatacttaaggtcaggagttcgagaccagcctggccaatatggtgaaacctcgtctctaccaaaaaaaaaaaaaaatacaaaaattagccaggcgcagtggtgcgcacctgtaatcccagctacttggaaggctgaggcaggagaatcccttgaaccgaggaggcgaaggttgcagtgagccgagattgtgccactgcactccagcctgggcgacagagcaagaccctgtctcaaaaaaattaaatcatgaatccccatcctggaagaggtaggtcccagcatccagccagattttctgcaatagtaatttaaacacacttttttatttccttccctttctgaattaaaaggaacaaaaaactgtcta

SEQ ID NO: 984 - DNA, 189 bp, Homo sapiens
atgaagattcaactttttttctttattctgcacttttgggtcacaattttaccagccagaagcaattttgaaccaaagtatagatttgaaagatgcgaaaaagtgagaggaatatgtaaaacgttttgtgatgatgttgagtatgattatggatactgcattaaatggagaagtcagtgctgcgtataa

SEQ ID NO: 985 - DNA, 2073 bp, Homo sapiens
cccagcaatgacattattcccagtgctgttgttcctggttgctgggctgcttccatcttttccagcaaatgaagataaggatcccgcttttactgctttgttaaccacccaaacacaagtgcaaagggagattgtgaataagcacaatgaactgaggagagcagtatctccccctgccagaaacatgctgaagatggaatggaacaaagaggctgcagcaaatgcccaaaagtgggcaaaccagtgcaattacagacacagtaacccaaaggatcgaatgacaagtctaaaatgtggtgagaatctctacatgtcaagtgcctccagctcatggtcacaagcaatccaaagctggtttgatgagtacaatgattttgactttggtgtagggccaaagactcccaacgcagtggttggacattatacacaggttgtttggtactcttcatacctcgttggatgtggaaatgcctactgtcccaatcaaaaagttctaaaatactactatgtttgccaatattgtcctgctggtaattgggctaatagactatatgtcccttatgaacaaggagcaccttgtgccagttgcccagataactgtgacgatggactatgcaccaatggttgcaagtacgaagatctctatagtaactgtaaaagtttgaagctcacattaacctgtaaacatcagttggtcagggacagttgcaaggcctcctgcaattgttcaaacagcatttattaaatacgcattacacaccgagtagggctatgtagagaggagtcagattatctacttagatttggcatctacttagatttaacatatactagctgagaaattgtaggcatgtttgatacacatttgatttcaaatgtttttcttctggatctgctttttattttacaaaaatatttttcatacaaatggttaaaaagaaacaaaatctataacaacaactttggatttttatatataaactttgtgatttaaatttactgaatttaattagggtgaaaattttgaaagttgtattctcatatgactaagttcactaaaaccctggattgaaagtgaaaattatgttcctagaacaaaatgtacaaaaagaacaatataattttcacatgaacccttggctgtagttgcctttcctagctccactctaaggctaagcatcttcaaagacgttttcccatatgctgtcttaattcttttcactcattcacccttcttcccaatcatctggctggcatcctcacaattgagttgaagctgttcctcctaaaacaatcctgacttttattttgccaaaatcaatacaatcctttgaattttttatctgcataaattttacagtagaatatgatcaaaccttcatttttaaacctctcttctctttgacaaaacttccttaaaaaagaatacaagataatataggtaaataccctccactcaaggaggtagaactcagtcctctcccttgtgagtcttcactaaaatcagtgactcacttccaaagagtggagtatggaaagggaaacatagtaactttacaggggagaaaaatgacaaatgacgtcttcaccaagtgatcaaaattaacgtcaccagtgataagtcattcagatttgttctagataatctttctaaaaattcataatcccaatctaattatgagctaaaacatccagcaaactcaagttgaaggacattctacaaaatatccctggggtattttagagtattcctcaaaactgtaaaaatcatggaaaataagggaatcctgagaaacaatcacagaccacatgagactaaggagacatgtgagccaaatgcaatgtgcttcttggatcagatcctggaacagaaaaagatcagtaatgaaaaaactgatgaagtctgaatagaatctggagtatttttaacagtagtgttgatttcttaatcttgataaatatagcagggtaatgtaagatgataacgttagagaaactgaaactgggtgagggctatctaggaattctctgtactatcttaccaaattttcggtaagtctaagaaagcaatgc

SEQ ID NO: 986 - DNA, 1953 bp, Homo sapiens
cgaggtcctcctcccagggcccggggctggggagcggaagccatcagtgggctcggaggacactgtcccagccaggacacggccatcggtcactaatctgcagcactggaatgtccgcgggccaatcagcgggcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaagccagggcagccctctgtggaaccccaaccccgagcctggcgtccggcctgtggcgcaccctgcaagtgggctggaacatgcagctgctacccgcgggcttggtgtcctttgtcgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagatcacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctg

SEQ ID NO: 987 - DNA, 1788 bp, Homo sapiens
acctcagacatgcagctcctgtccacacttaatatatgcatgcattggatcacccagccctggtctttctgcctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatgga

SEQ ID NO: 988 - DNA, 1549 bp, Homo sapiens
gaggaagtgctctcggtgtatttcctgtggtgggttcacacgcagctagacacagctaacttgagtcttggagctcctagagggaagcttctggaaaggaaggctcttcaggacctcttaggagccagtgtgaaggtgaaggaggaagcagatgcctgttcatatggaaacaaagacctggctgtgaagaggggaggcggacaccaaagtcctgacacttgggcgggacagaattgatctagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatgga

SEQ ID NO: 989 - DNA, 1037 bp, Homo sapiens
agaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgagctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatgga

SEQ ID NO: 990 - DNA, 1002 bp, Homo sapiens
gggagggtcccttcctcagggagcacaggaactctgagactcagcaagggtgtcctgggagggctcggggatgggagagtacacagattcacaactcattcagaactgtagaagatgatggatgtgaccaagatcactttagtcctaggggactagagaaggaaaatgacatgaggcagtggggtatctgtgtgttctcccactgaccacgctttctttagtgactcctgattgcctcctcaagtcgcagacactatgctgcctcccatggccctgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtagcagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttctgtttcttcctccccgctgtcatttcagtctcttcattttgtcatacggcctaaggctttaaagagcaataaaatttttagtctgc

SEQ ID NO: 991 - DNA, 2414 bp, Homo sapiens
cgggatgggaaaactatgcctggggccgacgctctgcccggctgctgccgctgaggaaagccgggacgcggagccccgccgagagcttctttgctccggacgcccctggacgtggcgggcagccgcgagggtaaccaccatgatcccctgggtgctcctggcctgtgccctcccctgtgctgctgacccactgcttggcgcctttgctcgcagggacttccggaaaggctcccctcaactggtctgcagcctgcctggcccccagggcccacccggccccccaggagccccagggccctcaggaatgatgggacgaatgggctttcctggcaaagacggccaagatggacacgacggcgaccggggggacagcggagaggaaggtccacctggccggacaggtaaccggggaaagccaggaccaaagggcaaagccggggccattgggcgggctggcccccgtggccccaagggggtcaacggtacccccgggaagcatggcacaccaggcaagaaggggcccaagggcaagaagggggagccaggcctcccaggcccctgcagctgtggcagtggccataccaagtcagctttctcggtggcagtgaccaagagctacccacgggagcggctgcccatcaagtttgacaagattctgatgaacgagggtggccactacaatgcttccagcggcaagttcgtctgcggcgtgcctgggatctactacttcacctacgacatcacgctggccaacaagcacctggccatcggcctggtgcacaacggccagtaccgcatccggacctttgatgccaacaccggcaaccacgatgtggcctcaggctccaccatcctggctctcaagcagggtgacgaagtttggctgcagatcttctactcagagcagaacgggctcttctatgacccttactggacagacagcctctttacgggcttcctaatctatgccgaccaggatgaccccaacgaggtatagacatgccacggcggtcctccaggcagggaacaagcttctggacttgggcttacagagcaagaccccacaactgtaggctgggggtggggggtcgagtgagcggttctagcctcaggctcacctcctctgcctctttttttccccttcattaaatccaaacctttttattcatccaaccatctatttattcacttctttttaaagtatctactgtgtaacaggcactatgctattctctgaaagatgcagcagtggacaagacagagtatctgtcctcatgcagcttacattctagcaggagatacaatttacaaatatacaagcaaataatataatattatgccaggatagaaatgaacatgccatggttgacagtaataggaataacaggagacagggaagaggtggaaatttgtttctttttttaagtttgcgtttttaggtttacttacatacagtgactctccagattttaagttgacaactcagtgaataatttttgcttatgtgcacactctgaaacctccatgtagatcaaagaacaagctatttccaacttctcacctcccttccccaaaagctctcttaagacccctctaagtcagtacctggaaaatttccatttttgagctgagttccaaagaaggaaatagagcaacacaaaggcctcgaaaagaggtctccagcaaaaggctctgcaagtgcaaagaccttgacaggaaagagggaggggccaaggtaagaactgagaagggaggcatgaggcgtgaggctggaagataatacagaatgtcccaggccatggcagagctcgttccattcacgaaggcttatcagaatacaaagtgacactgataggcggatcatcttgaatctgctcattgcatgagtcaagtcggccacagacttgagcgctttattattagttaatcttttgcaggcccgcttctcaatgaatgagatacaccaggatatgcacgtgcatctgagaaccgctgctctgagatggcaggaatggatcccacgcaaatgaatcgcaccccaagcacaggtgttgccagtatgcagggatctgggggcttaagaagctgcagtaaaagtgccaggtgctggcgggatgtggtagctcatgcctataatcccaggactttgggaagctgaggtggacggatcatttgaggtcaggagttcaagaccagcctgaccaacatggcaaaacatcgtctaaaaaaatacaaaaattagacaggcgtggtgttgggtgcctgtaatcccagctactggggaggctgaggcgggagaatcgcttgaacccaggaggtggaggttgcagttagctgagatcctgccactgcactccagcctgggcaacagagtgagactatctcaaaaaaaaacaaaaaaaaaaaaaaaacaa

SEQ ID NO: 992 - DNA, 439 bp, Homo sapiens
cgacggagcggccctggctgcagcctcccggcgccagcgaagacaggctgagatgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggtctggggctgcagggg

SEQ ID NO: 993 - DNA, 1470 bp, Homo sapiens
aaaatactaaccagccagagaaacagaatcctaactatttctgaggaaactgacttggcaacaagcattttgagaaatttattctgcccttgaacatctttgagcccattgagatgttctccaacgcaaacagcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggcatcaac

SEQ ID NO: 994 - DNA, 1753 bp, Homo sapiens
gctgttacctcttctggcgtccgtgcccgcggaagttcgctcctagggaagtcgctcgcgtcctcaagagcacctgagaggatctcggcgaagcggaaggctttggtgccagctgggagagtctgcgccggatttcctcagctccttggcgcgtttcctcggagccgggggaggcaaagcacggaccccggagtcggcgcccatagcgggacgccctcgcgaggggcgggagtgcgggagagccgagctgctgcccttgactggtgctcaggggaccacagctgcaatgacagtttgggcctgcaaaaagaaggctggaacaacgggagatggaagctttctgcaaatgcagcaccactggtatccatgaatttaacctgcccatcattcttcctaaacaagagactattgaaaagtcagggtgttcaaaatggcttcagatcttatcaggacaatcttggctgttgcactaatttccaaacttggcacagctgtagatgcagaactgatgccatctggtgcgattctacagaataagagagaaaatttacccagagtgtgccatgcactggcttttctgggaatggcaaggtgccaggatttgtttttggttcgcttgcaggggtggaaacttggaactaggttccaagatggtccccgcagcaccccacaagaagaaggaggaagcccacagagaaaacggggcatgccagttcaaatccacttccttttaaagagcttcctcagcagcccaataacttttgccttcatctcattggccagaactgtgtcattggctactgctatctgcaagattgtctgagaaatgtagtttttgtagctggatatataactgcctttgacaaaaatccagtttctcttgatgaagaagaagatgatggtggatcttgggaggacaactaacattttatgccctggctacagaatacagttgcagaggagcataaagttcaaaaagatcaaaactctagttccttcacaactgtcaaagctccaagcagcactgctcccctctgacagagtgagcagagtgaaggcatgtcaggtgttctcacaaaactcttgacagggctgacctctctcagtcaatatccttgtcccacatcaggattttctagagggccctgggtacctgtgcacttccttggtggccgtaacctctttgtggagggttggtgtaggataaagaatgttctattacgctgctccctcatctgtatcatttctctcctctctaattttcctgtcagttatattttggtggagtctgggtttgtgtatttgattcctatagaaagaccatcgctttcatgcatggaggaggggaatctacgcaaagaaaggctaccttactcctttctgtgactccaccaccagtctaggaatatcctgggagaagaattgcctctcaaagctgcttctataagcagcctacatcctagctaagcaaagaagaaacacttcccacatctagggctgtctaaaagaactttctgtgatgacagaaatgttctatatctgcagtgtccaatatggtaaccatataggcacatgtggctagtgaacacttgaaatgtggctagtgtgactgaggaaggaaaatttaaattttgtttaattgtaattaatttaaattcagatagccaaatggggctactagctattgtgttagatagcacggtatactttattctctttcttgtgttgtagaaccagctgggagaggtgtggg

SEQ ID NO: 995 - DNA, 2032 bp, Homo sapiens
tttggagggaggaatcccttcctcccggtgatccttactcatattctagccaccaaccacggttagtgcttgcggattgccgtgcaggagccgagctgctgcccttgactggtgctcaggggaccacagctgcaatgacagtttgggcctgcaaaaagaaggctggaacaacgggagatggaagctttctgcaaatgcagcaccactggtatccatgaatttaacctgcccatcattcttcctaaacaagagactattgaaaagtcagggtgttcaaaatggcttcagatcttatcaggacaatcttggctgttgcactaatttccaaacttggcacagctgtagatgcagaactgatgccatctggtgcgattctacagaataagagagaaaatttacccagagtgtgccatgcactggcttttctgggaatggcaaggtgccaggatttgtttttggttcgcttgcaggggtggaaacttggaactaggttccaagatggtccccgcagcaccccacaagaagaaggaggaagcccacagagaaaacggggcatgccagttcaaatccacttccttttaaagagcttcctcagcagcccaataacttttgccttcatctcattggccagaactgtgtcattggctactgctatctgcaagattgtctgagaaatgtagtttttgtagctggatatataactgcctttgacaaaaatccagtttctcttgatgaagaagaagatgatggtggatcttgggaggacaactaacattttatgccctggctacagaatacagttgcagaggagcataaagttcaaaaagatcaaaactctagttccttcacaactgtcaaagctccaagcagcactgctcccctctgacagagtgagcagagtgaaggcatgtcaggtgttctcacaaaactcttgacagggctgacctctctcagtcaatatccttgtcccacatcaggattttctagagggccctgggtacctgtgcacttccttggtggccgtaacctctttgtggagggttggtgtaggataaagaatgttctattacgctgctccctcatctgtatcatttctctcctctctaattttcctgtcagttatattttggtggagtctgggtttgtgtatttgattcctatagaaagaccatcgctttcatgcatggaggaggggaatctacgcaaagaaaggctaccttactcctttctgtgactccaccaccagtctaggaatatcctgggagaagaattgcctctcaaagctgcttctataagcagcctacatcctagctaagcaaagaagaaacacttcccacatctagggctgtctaaaagaactttctgtgatgacagaaatgttctatatctgcagtgtccaatatggtaaccatataggcacatgtggctagtgaacacttgaaatgtggctagtgtgactgaggaaggaaaatttaaattttgtttaattgtaattaatttaaattcagatagccaaatggggctactagctattgtgttagatagcacggtatactttattctctttcttgtgttgtagaaccagctgggagaggtgtgggtcagtcatgggcttggtatcccctggtcttcactattctagcttgccattgaatttgtctcccagaggaaaagaaagaatggtatttggaattaaattcaagatgttaacttgacatctatatattgcacatattcctgtatagtgaatggatgacctcctgggaatagttcctgtgactgattttagtgataattgatcatgaagaaatggcagtactgctccacttcaccttcctagtgactattatgtgttcctagtcagagtgactcagcagagattattttgttctcttgtgcaatttattctgtgtcattttatttttgtaatattgtggcagctaaatgattattctgtgtatgtttttcaaaatattaggtggcttatattttttaaaaggctatgaaataaaaataaactatacgtaacaca

SEQ ID NO: 996 - DNA, 3540 bp, Homo sapiens
ggagggctggggcggtacgaagcgggggtgggctctgcgcgtaatggcagcgccgtggcctcgcgtccatctttgccgttctctcggacctgtcacaaaggagtcgcgccgccgccgccgccccctccctccggtgggcccgggaggtagagaaaaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaagaaaaagaaaaaaaaaactctctaatcagttgtacacacattgaaacttatagccatggccagattttatgctaaaaatggtagtttgtcaaagacaaaattctcttagaatctaatccaacttgccagccctgagaaaatcccttttaaggccaaggaaagctgaatgctagcagccaggcctgtggtacttccatgagaaaccatagcagacaatgccctcccaagtactgaaatcacactggaatcccccttgttgggttcatttgattgtttaacacaggatgtgttgtgtcattctgaagtttttatttggggcagaagtctttatggagatgtaaatgacagcgtttctgggttatgcataacttctcactggtcagagacaccggtgtgtcaagcatggatattgcattgcaagacttgaatctataaaaattagaatcacacagtcagtactacaagcaaaacagagaacctgaaagaaggtgcacagactgtaagaaaaaacccaagtttgtgatatttcagtgattccaaagaacattctaggttttttgtttgtttttttgttttttgggttttttttttttactgcagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagttcaatcatgaattattgactatgtcttcatcaaaagtgttaatccctctcagggtctctggtgaagaccttcaagagtttggttttttctcccaggaaattggaaggtagaattgtaaattcatagaacttcttttataatggtgtacctcagcagctgcctttcaatttatgccaagtccttacagagtttatacttgaatagtaaatatgtcttctgagttttacagtgtcttaaactcaatgcacatttttttttcttctttttccaccccttcttgtttgtagttcattatacctgtcctattacagaactgatttccttcctggctgtacatgttggggtgctggatttttttccgtgtctttagtcttccataaatccacacacacacacacacacaaaaaatatatatatatataaatatatatgtaggatacatgttctcttctttagcttgtggtgaatacagtaatttgcattgaagaataaaacatctgttgccttttttgactaag

SEQ ID NO: 997 - DNA, 638 bp, Homo sapiens
gcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaattagacttagcacctcacagatgcttgggcctggaaatgaagccatgaaaatgaagccctcagccttcttggagatcagagccatggtcctcacccacagcacatgggtctctaaacctggacctcaactcgcccatctgtaaaatgagggacttacattaaattcctacagctcctttcagcttga

SEQ ID NO: 998 - DNA, 229 bp, Homo sapiens
agaaggacgcaggcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacaggccggcaggtctgtgctgaccccagtgaggagtgggtccagaaatacgtcagtgacctggagctga

SEQ ID NO: 999 - DNA, 244 bp, Homo sapiens
agaaggacgcaggcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccactctccagaccaagagaggccggcaggtctgtgctgaccccagtgaggagtgggtccagaaatacgtcagtgacctggagctga

SEQ ID NO: 1000 - DNA, 4154 bp, Homo sapiens
aggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggc

SEQ ID NO: 1001 - DNA, 5163 bp, Homo sapiens
ccagccatgggctcggggcgcgtacccgggctctgcctgcttgtcctgctggtccacgcccgcgccgcccagtacagcaaagccgcgcaagatgtggatgagtgtgtggaggggactgacaactgccacatcgatgctatctgccagaacaccccgaggtcatacaagtgcatctgcaagtctggctacacaggggacggcaaacactgcaaagacgtggatgagtgcgagcgagaggataatgcaggttgtgtgcatgactgtgtcaacatccctggcaattaccggtgtacctgctatgatggattccacctggcacatgacggacacaactgtctggatgtggacgagtgtgccgagggcaacggcggctgtcagcagagctgtgtcaacatgatgggcagctatgagtgccactgccgggaaggcttcttcctcagcgacaaccagcatacctgtatccagcggccagaagaaggaatgaattgcatgaacaagaaccacggctgtgcccacatttgccgggagacacccaaggggggtattgcctgtgaatgccgtcctggctttgagcttaccaagaaccaacgggactgtaaattgacatgcaactatggtaacggcggctgccagcacacgtgtgatgacacagagcagggtccccggtgcggctgccatatcaagtttgtgctccataccgacgggaagacatgcatcggggaaaggcggctagagcagcacatccccactcaagccgtttctaatgagacctgtgctgtcaacaacgggggctgtgacagtaagtgccatgatgcagcgactggtgtccactgcacctgccctgtgggcttcatgctgcagccagacaggaagacgtgcaaagatatagatgagtgccgcttaaacaacgggggctgtgaccatatttgccgcaacacagtgggcagcttcgaatgcagttgcaagaaaggctataagcttctcatcaatgagaggaactgccaggatatagacgagtgttcctttgatcgaacctgtgaccacatatgtgtcaacacaccaggaagcttccagtgtctctgccatcgtggctacctgttgtatggtatcacccactgtggggatgtggatgaatgcagcatcaaccggggaggttgccgctttggctgcatcaacactcctggcagctaccagtgtacctgcccagcaggccagggtcggctgcactggaatggcaaagattgcacagagccactgaagtgtcagggcagtcctggggcctcgaaagccatgctcagctgcaaccggtctggcaagaaggacacctgtgccctgacctgtccctccagggcccgatttttgccagagtctgagaatggcttcacggtgagctgtgggacccccagccccagggctgctccagcccgagctggccacaatgggaacagcaccaactccaaccactgccatgaggctgcagtgctgtccattaaacaacgggcctccttcaagatcaaggatgccaaatgccgtttgcacctgcgaaacaaaggcaaaacagaggaggctggcagaatcacagggccaggtggtgccccctgctctgaatgccaggtcaccttcatccaccttaagtgtgactcctctcggaagggcaagggccgacgggcccggacccctccaggcaaagaggtcacaaggctcaccctggaactggaggcagaggtcagagccgaagaaaccacagccagctgtgggctgccctgcctccgacagcgaatggaacggcggctgaaaggatccctgaagatgctcagaaagtccatcaaccaggaccgcttcctgctgcgcctggcaggccttgattatgagctggcccacaagccgggcctggtagccggggagcgagcagagccgatggagtcctgtaggcccgggcagcaccgtgctgggaccaagtgtgtcagctgcccgcagggaacgtattaccacggccagacggagcagtgtgtgccatgcccagcgggcaccttccaggagagagaagggcagctctcctgcgacctttgccctgggagtgatgcccacgggcctcttggagccaccaacgtcaccacgtgtgcaggtcagtgcccacctggccaacactctgtagatgggttcaagccctgtcagccatgcccacgtggcacctaccaacctgaagcaggacggaccctatgcttcccttgtggtgggggcctcaccaccaagcatgaaggggccatttccttccaagactgtgacaccaaagtccagtgctccccagggcactactacaacaccagcatccaccgctgtattcgctgtgccatgggctcctatcagcccgacttccgtcagaacttctgcagccgctgtccaggaaacacaagcacagactttgatggctctaccagtgtggcccaatgcaagaatcgtcagtgtggtggggagctgggtgagttcactggctatattgagtcccccaactacccgggcaactacccagctggtgtggagtgcatctggaacatcaaccccccacccaagcgcaagatccttatcgtggtaccagagatcttcctgccatctgaggatgagtgtggggacgtcctcgtcatgagaaagaactcatccccatcctccattaccacttatgagacctgccagacctacgagcgtcccattgccttcactgcccgttccaggaagctctggatcaacttcaagacaagcgaggccaacagcgcccgtggcttccagattccctatgttacctatgatgaggactatgagcagctggtagaagacattgtgcgagatggccggctctatgcctctgaaaaccaccaggagattttaaaggacaagaagctcatcaaggccttctttgaggtgctagcccacccccagaactacttcaagtacacagagaaacacaaggagatgctgccaaaatccttcatcaagctgctccgctccaaagtttccagcttcctgaggccctacaaatagtaaccctaggctcagagacccaattttttaagcccccagactccttagccctcagagccggcagccccctaccctcagacaaggaactctctcctctctttttggagggaaaaaaaaaatatcactacacaaaccaggcactctccctttctgtctttctagtttcctttccttgtctctctctgcctgcctctctactgttcccccttttctaacacactacctagaaaagccattcagtactggctctagtccccgtgagatgtaaagaaacagtacagccccttccactgcccattttaccagctcacattcccgaccccatcagcttggaagggtgctagaggcccatcaaggaagtgggtctggtgggaaacggggaggggaaagaagggcttctgccattatagggttgtgccttgctagtcaggggccaaaatgtcccctggctctgctccctagggtgattctaacagcccagggtcctgccaaagaagcctttgatttacaggcttaatgccagcaccagtcctctggggcacatggtttgagctctggacttcccacatggccagctttcttgtctatacagatcctctctttctttccctacgtctgcctggggtctactccataagggtttacaaatggcccacaacactgagttagtggacaccggctaaatgaggaagagcagcaggcattgtcatggtgaatgccccgctgtagctccctgagagaaagactgtaactctgcaggacagaaacaaggttttaaagcattgccaaaaaaaagaaaacagaaagaaaaaatgtatcatctaaaggactagacacagaacaattggaagtcaacttcaaacactaatcccttttcttgtcttccctggcccagccacctcctcagccccatgtgatgctccctgggggagccctactccccttgctacatgttgtccttaaacatggttattgacctgaagccagcctaggccttgccctacagttgtttttcccttgtagccccagctggcttgtgggcttcaccaaagaggaccccactctgaagccagcctggagccacctacctctggcctcaggctgtgggcagcaaaaggaatgtgtgtgcacttggcgagcctcctgcccaccctgtccacacctaataagtgcaatcattttgagtctttctatgttgtctagacggaggggtttttgttttctgggtttgttttttgtttttgtttcttcttcctctattagcaaaaccctatttatagctgcccaagagaaaagagtgtatgtttggagtggaagaaaatcggttttgaatctcatgaaccttgagtgctggagcatctgatctgtctctatgccaccactggccacctagagcccttggctgtggtaatccagggtaattgcgcagaggcatctgatgtgtaggaaagtaattctggggatttgatggagcagaaaggagagagacctatgtttgctaaaccaatcttgctatccctatgcctctccatggagtcagtgtggacctcatgattatagaggccaatggaactggtcagtgattctctaccccaagtagggaaaacctccatcttttccctgtcttcatcctgttatcccctggtgtacacatggaagaggaccaggacataccacctggggatgggctgactcagggtcccgaggccagagacaaagctgtgggagccaagaataagacagaaggcatcagatatttgcctggctctggtcacttccctttgaagttgacttcaagcttagcttcctcaactactgtttttcagaaggaagaaagaatcaaatggaagaagaatcaagtccatgcccaagcccaaagcctgcacacattctgcccttaatccaagtgttgcctataaaattattttctgttttctcactctagttcccccaaagctgtagtcccaatcaatcaaaggctaccaactgagtcctcaggttcatttcttttttttttttttttctttttaactctcctggtaactcacagaacagctcaggttcatttctaggtgactgtcctaggctactgctcccccaggagactcaacactaaataaaggagtc

SEQ ID NO: 1002 - DNA, 2037 bp, Homo sapiens
cgcctccgccttcggaggctgacgcgcccgggcgccgttccaggcctgtgcagggcggatcggcagccgcctggcggcgatccagggcggtgcggggcctgggcgggagccgggaggcgcggccggcatggaggcgctgctgctgggcgcggggttgctgctgggcgcttacgtgcttgtctactacaacctggtgaaggccccgccgtgcggcggcatgggcaacctgcggggccgcacggccgtggtcacgggtgagtgcggaggcgggtgagtgcgagctggcggggcgcgcggagaggaggccgggccggcggtagcagcggcccgccgggctcagctcagctcggctcccgcccgcggtccgcaggcgccaacagcggcatcggaaagatgacggcgctggagctggcgcgccggggagcgcgcgtggtgctggcctgccgcagccaggagcgcggggaggcggctgccttcgacctccgccaggagagtgggaacaatgaggtcatcttcatggccttggacttggccagtctggcctcggtgcgggcctttgccactgcctttctgagctctgagccacggttggacatcctcatccacaatgccggtatcagttcctgtggccggacccgtgaggcgtttaacctgctgcttcgggtgaaccatatcggtccctttctgctgacacatctgctgctgccttgcctgaaggcatgtgcccctagccgcgtggtggtggtagcctcagctgcccactgtcggggacgtcttgacttcaaacgcctggaccgcccagtggtgggctggcggcaggagctgcgggcatatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgaa

SEQ ID NO: 1003 - DNA, 4846 bp, Homo sapiens
cgagccagcgagcgagcagagcacatcgctgcgggctcacaaagcggccagacgctcggcggcggcgtgtggcaggagcgcaggggcgcgagccggcgatcagccttcccggcgaccgtgccgcgggagctcgagcaactcggactaggggacccgggccggcccccaagatgccggcgatcgcggtgttggcggcggccgccgcggcgtggtgcttcctccaagtcgagagccggcacctggacgcgctcgccggaggcgcgggccccaaccacggcaatttcctagacaatgaccagtggctgagcaccgtctcccagtacgaccgggacaagtactggaaccgctttcgagacgatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtagtgcccacaagaaagaggacacaagttttgcacaaaattgcaagtcacttcctattcctgcatttgtatctaagactccaaggcaccaaggtctcttctccattgttgctctctatacccgacctaaggtttggaagacaactgcttgttcccagaggattctgattttgcatatgtttgtatgggagaaagggtgttgtgttttttttttgttgttgtttattttttggatagggaagtcattggcttaattagagcctccttcctttctgtgagatttttccaacaagcatgtgatttacgtggaattctgacagtgcagggagccccaaccctcttaaatgtcaaagaccctttttgattacccacactggtggttattacagcatggttcccagccttacagtgtctaagtgcttctcttgtgtcctgtagatgttgtgaaaaagaaaaaaacaaaaaatacaccacactgtactttttccccctgcccccgttactgccggtgattattattaaaaattagtttttttcacatcattatatctggcttcctataaacaacagccttaattcagtcaagactccctttggggaattcattttattaaaaattggtgtctggatacttccctgtacatgcataaatatgcatgcatgtacagaaagactgtatgtgtgtgccttgcacacacacccatacctctcagaaaaagtgtttgggtatcttaaaaactcgaaaaacaatgataaatttctcagcttgtccagacctggaacaaaatttctggaataagaaatttgtattaaagtccttttttgcactaacagttggctcttgtagcctgcaggctgaggaagtctcttctctgtgcatcagcagagttactgaaagcctctgattgagaaaaaacctccgtctgcctaaatcacttttctcgcagaagccatgcgactcccacacgacacgggcagcttcacaagccatctctttcatttctgcttgaagccccttggctgcagcaatcctgtctgccataggtttcttccttccttacctactcaagggctttttctaaggcatgcacacatatctcctgttctctgagagtaccatggtgttccttaaaagaagaaaatttctaattctgaactcaatgttttgcttttactccctttctactgacaaatcatgataagggcacaaaagctgtacagatttttttttttaaccactcaatcccaaatggaggcctacaaagaacatcgtaataacacatggaagcaaaccctgggtttttaagagcaaattctgtccccccctcactcccccaagtgacaagatactaatgaagaaagttcttcaccatagtgtttgttttaactaaactcattggagtctagttccaaatttggtagggtcatcatctctacattccttaggatttctctccctatcaagctggcccagatacaagtaccaaacagtagtctctgaagttcccccatttccttcagtaccagtctataagctactgtccgccactgattttcatttatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaatagacagttcccagtaaggtaatgagatgccattttcagagacattctaagaagatattttgattcattaaaacattaaataaaaagccctcctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaa

SEQ ID NO: 1004 - DNA, 5217 bp, Homo sapiens
agagaggccaagaggtttctgcttctattgatgttagcatttggttataaccacgggcaaagaatattaagctttgtcagagacccttcagcacttccatagagccatcccactagaggtcacagatcacaaaaaccctacagaaacaggaaaccgaacttcctgagtacgctacaaaacacagaaacctgtttcctctacacatctcaaactggcaaaactcagtcttagcagattcagtgtggaagcagctatcaaaaaggccataaggattttgtccccaaatttcacatgagctaccttgcttcaaactactgagatgaagggggcaagattatttgtccttctttctagtttatggagtgggggcattgggcttaacaacagtaagcattcttggactatacctgaggatgggaactctcagaagactatgccttctgcttcagttcctccaaataaaatacaaagtttgcaaatactgccaaccactcgggtcatgtcggcggagatagctacaactccagaggcaagaacttctgaagacagtcttcttaaatcaacactgcctccctcagaaacaagtgcacctgctgagggtgtgagaaatcaaactctcacatccacagagaaagcagaaggagtggtcaagttacagaatcttaccctcccaaccaacgctagcatcaagttcaatcctggagcagaatcagtggtcctttccaattctacactgaaatttcttcagagctttgccagaaagtcaaatgaacaagcaacttctctaaacacagttggaggcactggaggcattggaggcgttggaggcactggaggcgtgggaaatcgagccccacgggaaacatacctcagccggggtgacagcagttccagccaaagaactgactaccaaaaatcaaatttcgaaacaactagaggaaagaattggtgtgcttatgtacataccaggttatctcccacagtgatattggacaaccaggtcacttatgtcccaggtgggaaaggaccttgtggctggaccggtggatcctgtcctcagagatctcagaagatatccaatcctgtctataggatgcaacataaaattgtcacctcattggattggaggtgctgtcctggatacagtgggccgaaatgtcaactaagagcccaggaacagcaaagtttgatacacaccaaccaggctgaaagtcatacagctgttggcagaggagtagctgagcagcagcagcagcaaggctgtggtgacccagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaaggcaagaaatgactcttacatgtgagaagcctattaaagaactagaagtaaagcagactcatttagaaggtgctctagaacaggaacactcaagaagcattctgtattatgaatccctcaataaaactctttctaaattgaaggaagtacatgagcagcttttatcaactgaacaggtatcagaccagaagaatgctccagctgctgagtcagttagcaataatgtcactgagtacatgtctactttacatgaaaatataaagaagcagagtttgatgatgctgcaaatgtttgaagatttgcacattcaagaaagcaagattaacaatctcaccgtctctttggagatggagaaagagtctctcagaggtgaatgtgaagacatgttatccaaatgcagaaatgattttaaatttcaacttaaggacacagaagagaatttacatgtgttaaatcaaacattggctgaagttctctttccaatggacaataagatggacaaaatgagtgagcaactaaatgatttgacttatgatatggagatccttcaacccttgcttgagcagggagcatcactcagacagacaatgacatatgaacaaccaaaggaagcaatagtgataaggaaaaagatagaaaatctgactagtgctgtcaatagtctaaattttattatcaaagaacttacaaaaagacacaacttacttagaaatgaagtacagggtcgtgatgatgccttagaaagacgtatcaatgaatatgccttagaaatggaagatggcctcaataagacaatgactattataaataatgctattgatttcattcaagataactatgccctaaaagagactttaagtactattaaggataatagtgagatccatcataaatgtacctccgatatggaaactattttgacatttattcctcagttccaccgtctgaatgattctattcagactttggtcaatgacaatcagagatataactttgttttgcaagtcgccaagacccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattatatttcagttaaaaaaggcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaatttaacttgttgtatagatcgatcgttgcctggtagtctggcaaatgttgtcaagtctcagaagcaagtaaaatcattgccaaagaaaattaacgcacttaagaaaccaacggtaaatcttaccacagtcctgataggccggactcaaagaaacacggacaacataatatatcctgaggagtattcaagctgtagtcggcatccgtgccaaaatgggggcacgtgcataaatggaagaactagctttacctgtgcctgcagacatccttttactggtgacaactgcactatcaagcttgtggaagaaaatgctttagctccagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaatggtaattacaacatattatcagtcacagttttctttccaattaaacacttaacttttgttattccctgtatataaatatataacacacattttctagattcacaaatttaaataaattactcaaaaaatgaaaattgattttgtaaacttttatttttactctttacgttgagttgatcaattttccatactaagattttcattcagaatcaaaattaagaaagttggactgaaaatatgaaaaatgcttaactattgttctcttcctataattctctaattataacatagtaatttacatgtagttggacatgtacactcaagtctaagaatatatgagtggatcatttaccgccccccgccccacaacatctataaggggcaaaaagtctttttctaataagtattcttctatggtagtacctacagatctgcccttcttcttctaaagggtaagtcataatctgtgtaatactacaatttatgggatgctcactatgccctgtttctcttctaaacaatttacatgtaatgtctcattcctcacaataacccttgtaaagtgggcatgattaccatgatttttatagttgaagaacctaagacacagagaccaaggcccatgagctcatagggctgaggcaggatttggaatcaggccatgtcttctccagagcccacatccatcctttctctatattgcctcccacagatgtgctaaaatttatttaactaatcctttatcctctatttgtgttgtctcccattttttattattacaatattactgtggtgaacatgcttaaaaatacattccttggatatctgacaacgtgtttctgaaaaacagattttcataagtaataataaaaataataataaaaaagttttggtatggtaa

SEQ ID NO: 1005 - DNA, 2805 bp, Homo sapiens
atgaagggggcaagattatttgtccttctttctagtttatggagtgggggcattgggcttaacaacagtaagcattcttggactatacctgaggatgggaactctcagaagactatgccttctgcttcagttcctccaaataaaatacaaagtttgcaaatactgccaaccactcgggtcatgtcggcggagatagctacaactccagagaaagcagaaggagtggtcaagttacagaatcttaccctcccaaccaacgctagcatcaagttcaatcctggagcagaatcagtggtcctttccaattctacactgaaatttcttcagagctttgccagaaagtcaaatgaacaagcaacttctctaaacacagttggaggcactggaggcattggaggcgttggaggcactggaggcgtgggaaatcgagccccacgggaaacatacctcagccggggtgacagcagttccagccaaagaactgactaccaaaaatcaaatttcgaaacaactagaggaaagaattggtgtgcttatgtacataccaggttatctcccacagtgatattggacaaccaggtcacttatgtcccaggtgggaaaggaccttgtggctggaccggtggatcctgtcctcagagatctcagaagatatccaatcctgtctataggatgcaacataaaattgtcacctcattggattggaggtgctgtcctggatacagtgggccgaaatgtcaactaagagcccaggaacagcaaagtttgatacacaccaaccaggctgaaagtcatacagctgttggcagaggagtagctgagcagcagcagcagcaaggctgtggtgacccagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaagaggagtattcaagctgtagtcggcatccgtgccaaaatgggggcacgtgcataaatggaagaactagctttacctgtgcctgcagacatccttttactggtgacaactgcactatcaagcttgtggaagaaaatgctttagctccagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaatggtaattacaacatattatcagtcacagttttctttccaattaaacacttaacttttgttattccctgtatataaatatataacacacattttctagattcacaaatttaaataaattactcaaaaaatgaaaattgattttgtaaacttttatttttactctttacgttgagttgatcaattttccatactaagattttcattcagaatcaaaattaagaaagttggactgaaaatatgaaaaatgcttaactattgttctcttcctataattctctaattataacatagtaatttacatgtagttggacatgtacactcaagtctaagaatatatgagtggatcatttaccgccccccgccccacaacatctataaggggcaaaaagtctttttctaataagtattcttctatggtagtacctacagatctgcccttcttcttctaaagggtaagtcataatctgtgtaatactacaatttatgggatgctcactatgccctgtttctcttctaaacaatttacatgtaatgtctcattcctcacaataacccttgtaaagtgggcatgattaccatgatttttatagttgaagaacctaagacacagagaccaaggcccatgagctcatagggctgaggcaggatttggaatcaggccatgtcttctccagagcccacatccatcctttctctatattgcctcccacagatgtgctaaaatttatttaactaatcctttatcctctatttgtgttgtctcccattttttattattacaatattactgtggtgaacatgcttaaaaatacattccttggatatctgacaacgtgtttctgaaaaacagattttcataagtaataataaaaataataataaaaaagttttggtatggt

SEQ ID NO: 1006 - DNA, 1555 bp, Homo sapiens
cgggcggctgctgaggtgagggccgggccagaggagaggcatacccactggggcgtaggtctgggactccccctgtccgccctggcgcgacctcaggactctccgtgtcccctccgtgacccccgcggcccgggccgctctttgcatcttgtcttgcccacagctggcctcggccaggtccgagggcctggatgcgaccttggggcagcccctactcttccgggcagcccacttccgcggccaccggtgcagggcatgccccggggccgtggagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccaggacccagaataaagccaatgatttacttgtttcacctg

SEQ ID NO: 1007 - DNA, 834 bp, Homo sapiens
atgtgcaccgtagtggaccctcgcattgtccggagatacctactcaggcggcagctcgggcagggggcctatggcattgtgtggaaggcagtggaccggaggactggtgaggtcgtggccatcaagaaaatctttgatgcttttagggataagacagatgcccagagaacattccgggaaatcacgctcctccaggagtttggggaccatcccaacatcatcagcctccttgacgtgatccgggcagagaacgacagggacatttacctggtgtttgagtttatgggttgcccccccagccccccacccccgactgcagtgcgcaccctctctgcagacactgacctgaacgcagtcatccggaagggcggcctgctgcaggacgtccacgtgcgctccatcttctaccagctcctgcgggccacccggttcctccactcggggcacgttgtgcaccgggaccagaagccgtccaatgtgctcctggatgccaactgcacagtgaagctgtgtgactttggcctggcccgctccctgggcgacctccccgaggggcctgaggaccaggccgtgacagagtacgtggccacacgctggtaccgagcaccggaggtgctgctctcttcgcaccgatacacccttggggtggacatgtggagtctgggctgtatcctgggggagatgctgcgggggagacccctgttccccggcacgtccaccctccaccagctggagctgatcctggagaccatcccaccgccatctgaggaggacctcctggctctcggctcaggctgccgtgcctctgtgctgcaccagctggggtcccggtga

SEQ ID NO: 1008 - DNA, 765 bp, Homo sapiens
atgtgcaccgtagtggaccctcgcattgtccggagatacctactcaggcggcagctcgggcagggggcctatggcattgtgtggaaggcagtggaccggaggactggtgaggtcgtggccatcaagaaaatctttgatgcttttagggataagacagatgcccagagaacattccgggaaatcacgctcctccaggagtttggggaccatcccaacatcatcagcctccttgacgtgatccgggcagagaacgacagggacatttacctggtgtttgagtttatggacactgacctgaacgcagtcatccggaagggcggcctgctgcaggacgtccacgtgcgctccatcttctaccagctcctgcgggccacccggttcctccactcggggcacgttgtgcaccgggaccagaagccgtccaatgtgctcctggatgccaactgcacagtgaagctgtgtgactttggcctggcccgctccctgggcgacctccccgaggggcctgaggaccaggccgtgacagagtacgtggccacacgctggtaccgagcaccggaggtgctgctctcttcgcaccgatacacccttggggtggacatgtggagtctgggctgtatcctgggggagatgctgcgggggagacccctgttccccggcacgtccaccctccaccagctggagctgatcctggagaccatcccaccgccatctgaggagggggcccagactgcctgcaggtcaggcacaggggcatctacctag

SEQ ID NO: 1009 - DNA, 551 bp, Homo sapiens
ggccgttggttggtgcgcggctgaagggtgtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaaggcacctggcaccaggcagctggggaggagggcagctctccagggagggacccagcctagcacctgaaggatcaatgccatcaccccgcggggacctcccctaa

SEQ ID NO: 1010 - DNA, 699 bp, Homo sapiens
atggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaaacaggacacgagcatgagaccacgctcctctgccttctcctggcctgggacacacagagccaccccggccttcctggtatcgccagccttaaggtgtctggagcccccacacttggccaacctgaccttggaagatgctgctgagtgtctcaagcagcactga

SEQ ID NO: 1011 - DNA, 1496 bp, Homo sapiens
ggtggctctatggactcggcccctctgttccccaggccccacctcttccagaacctcctgctcttcctgtgggccctgctgaactgtggtttgggggtcagtgctcagtagggtccgggcgagtggaccccgtgggtgtcctggacccgctgctccagctcctgcgggcgtggcgtctctgtgcgcagccggcgctgcctccggcttcctggggaagaaccgtgctggggagactcccatgagtaccgcctctgccagttgccagactgccccccaggggctgtgcccttccgagacctacagtgtgccctgtacaatggccgccctgtcctgggcacccagaagacctaccagtgggtgcccttccatggggcgcccaaccagtgcgacctcaactgcctggctgaggggcacgccttctaccacagcttcggccgcgtcctggacggcaccgcctgcagcccgggtgcccagggggtctgcgtggctggccgctgccttagcgccggctgtgatgggttgttgggctcgggtgccctcgaggaccgctgtggccgctgcggaggcgccaacgactcgtgccttttcgtgcagcgcgtgtttcgtgacgccggtgccttcgctgggtactggaacgtgaccctgatccccgagggcgccagacacatccgcgtggaacacaggagccgcaaccacctggcactgatggggggcgatgggcgctacgtgcttaatgggcactgggtggtcagcccaccagggacctacgaggcggccggcacgcatgtggtctacacccgagacacagggccccaggagacattgcaagcagccgggcccacctcccatgacctgctcctacaggtcctcctgcaggagcccaaccctggcatcgagtttgagttctggctccctcgggagcgctacagccccttccaggctcgtgtgcaggccctgggctggcccctgaggcagcctcagccccggggggtggagcctcagccccccgcagcccctgctgtcacccctgcacagaccccaacgctggccccaggcccgagtgctgggccaccaccaccaggcccaggagacccgctatgaggtgcgcatccagctcgtctacaagaaccgctcgccactgcgggcacgcgagtacgtgtgggcgccaggccactgcccctgcccgatgctggcaccccaccgggactacctgatggctgtccagcgtcttgtcagccccgacggcacacaggaccagctgctgctgccccacgccggctacgcccggccctggagccctgcggaggacagccgcatacgcctgactgcccggcgctgtcctggctgagcccctgcaggagccccggccacacacagcaagaaagatacatctgaccagcctcaacgtcaacgtatttcccctctcaccctggcttccaggcagctctgaaatacgtcccacctgtgcagctatgtgactccctcccacacacgct

SEQ ID NO: 1012 - DNA, 535 bp, Homo sapiens
cgcccacgcccggcgccccgaccgcggaggactccccgagccccgcccgccatggcccggatcccgacggccgccctgggttgcatcagcctcctctgcctgcagctccctggctcgctgtcccgcagcctgggcggggacccgcgacccgtcaaacccagggagcccccagcccggagcccttccagcagcctgcagcccaggcaccccgcaccccgacctgtggtctggaagcttcaccgggccctccaggcacagaggggtgccggcctggcccctgttatgggtcagcctctccgggatggtggccgccaacactcgggcccccgaagacactcgggcccccgcaggacccaagcccagctcctgcgagtgggctgtgtgctgggcacctgccaggtgcagaatctcagccaccgcctgtggcaactcatgggaccggccggccggcaggactcagctcctgtggaccccagcagcccccacagctatggctgaggtggggccgggccacacccctgcccatcccagccag

SEQ ID NO: 1013 - DNA, 4276 bp, Homo sapiens
attcagccctggaggtgccatcccgggccgcgactccgctccaggcaggacccccaacccgcccagcccgctccgccttgcgccccggacccgcggccgaccccagacccgctgcccgcttcgcgcccgaggcctgcgccccgacggacgcccgtgcccagcttgccacgcccacgcccggcgccccgaccgcggaggactccccgaggtgccggcggagggggtggctcgcggctcaggctgcccccgacgtgcccggctcaccgccccctcccctgcagccccgcccgccatggcccggatcccgacggccgccctgggttgcatcagcctcctctgcctgcagctccctggctcgctgtcccgcagcctgggcggggacccgcgacccgtcaaacccagggagcccccagcccggagcccttccagcagcctgcagcccaggcaccccgcaccccgacctgtggtctggaagcttcaccgggccctccaggcacagaggggtgccggcctggcccctgttatgggtcagcctctccgggatggtggccgccaacactcgggcccccgaagacactcgggcccccgcaggacccaagcccagctcctgcgagtgggctgtgtgctgggcacctgccaggtgcagaatctcagccaccgcctgtggcaactcatgggaccggccggccggcaggactcagctcctgtggaccccagcagcccccacagctatggctgaggtggggccgggccacacccctgcccatcccagccagggtgctgtgcccccgtccagagctgcagctgagccccatctgaagcccagtccctcggagctgcagacagcaggtcctgcagcaacaatacctgcacggctttgcacacgtaaacctaggctggtctacacgcagtgctggtacgtcaaggagcctaaacaccctgaaattgtgaccccctgggggacagctgccagacacagctggcggcagcaccagatgctaagcgcttcagagaggaggtgtctgcccagagatgtggagcagaagctgggccctgaacacacggggccatgtctggacgagcaggggagagaggctgaactggccagaagtggcccctccgctgctggtccagtcagactgaagcccggccttgtgcctgggctgttcctgctctcatgcacaaccagcccttccacgtgcctgcctgtgggacaggagggggagcgtgggatgctgtagcccccggggttgggcaagggaaggatggtggccctccagaggtcatgaagggacctctgtggctccagctgccaaccctggagcccagaccgaggtggccatggagactccacctggatcccctgtaggaggccagggaggggaactcagcagttcaggagccaccccaaaccattctgggacagggacacccctttctaccccagggcagggcagggctgggtggggcaagatcccccagcccgactagacccacctcacctgaagggggtgagacccttgttggcagccagacaagggtggggctccacaggcagcacaggcgccccaccaccacccagtttggggacccagtgggaccaggtgcgggggcagagggtgacttaccaagagccagggagggcagcccaggcccaagtgacagcaagaacaagaaccactgccggcgtgcacagacttggtgtgtgtccttccctggggggacgggggactcacatgtgcctgccactggagcctctcaaccgtccagcagaacacggggttcagaaagggctccttctgctatttagcgaacactgagcatttaatttacaaatgtttgctagggtcaccctctcggccatcccacgagggtcgccatgatcaccccaactctagaggccgcagcagagctcaggacattcccccacagagcttgcccctcagttcctacctccaagggggagggtcctggaagcgcccacccaggcgccgcccctgtgcttgctccccgagctcagggattgccgagtccacgtaactgacctgtactccacgaggccctgtgggaacggtccaggctggtcctgccctgtggaggcctccgtgcactgagagatgtactaggattgcagcaaaggtggtcagggtgatgggccgcacagcgaggcagtcaaggccagctccctgggagaagcactgggtcaggtgaggtctgaggacagcaggccttccctaggggaaggagctgggagtgccaaggccccaggtgcacaggaggcgtggctgctgagaggctgcagggtggaggggcctcggcctcagagtcatgtgccctgtgaccactgaagggtgtcagcagagcacacggcatgaggacagagggaggggcacggggagtgaaggagggggccctggggcaaggctcgggggtcaggagctcagcgtccgctactcagcccagccaaaaccctcccagacgtctcctctcctgcctgggcaaagtccagcttggcaccccgtctggggcctgcctgtggtcagggccaagtgttccctcctccaggaaagcctttaccctcctcatgccctgtagtcaggaggccgcctgctgtaaccctccgtgtcgcctcgggtgcgaaatcagacccacctgacaccatcacgcggaggcccagcagcacctgcacccacttccagctgctctggccaaaatctccgctcggccaggccccgtggctcacacctgtaatcctagcacattgggaggccaaggcaggcacatcacctgagttcaggagttcaagaccagcctggccaacatggtgaaatcccgtctctactaaaaacagaaaattatccgggcgtggtggcacatgactgtaatcccagctactcaggaggctgaggcaggaggatcacttgaacctgggaggcggaggttgcagtgagctgagattgcgccattgcactccagcctgggcaacaagagcaaaattctgcctcaaaaaaaaaaatagtaataatacaaaaattagctgggcgtggtggcacatgccagtaattccatctactcgggaggctgaggcaggagaatcgtctaagcccgggaggtggaggttgcagtgagcccagatggcgctgctgcactcaagcttggatgacagagcaagactccgtttcaaaaaaaaaaaacctcctctcttccttcacaccttcctctgaatcccacccggtcccacctcctgaacctatccagacaccttctcctgacccaggcaccacctgctttcggggcgatggccgtagcctcctcccaggcacctgtctgcatccctctggccagtgcatgctgagcacgtgacctacccgtgttgggacacgtgaggatacagccttgacccccaggggctgacattctagggggagatagaaggagacaaacgtagaaggtagaataagtgggtggtggagtggcagggagtgctgagtgccacaggaagtcagacaaggaaggagagtgtggggcaggtgccgtttaaatggggggcgctggggtctcctcacagttgcttctcagctcagctgtgccaggatcttgttgagtcaggtcagctgcccacagccctcttgcctgacccctgaagcccagaactctgatcttcacagccctaggtatggccccagcaccccactgccctctctcctgccccagccgactgctgttcccagacttccctggccacgctccaagacgccagctctgccgcgggcactttgttctcacggtgtcctccatgcctgcagggcccatgcatgggaagttgcgttggcggcctgggtgttggcggttccgtgcctgctccaactctccgtgaggcccctctcccagagcctgacacactctgtggccgaactctaggcaggtgcccctgagtcctttcctcgacgaggcctgaccccatccccatcctcgctgggcccgccgaccccggtgttagcaagaatcctctaaatcagtttatggagaattacccaccctcgatatctgatcccattcctcatctcccacccttgatctcatcaccctgccggcctcctgcaagatcctcattgagccactccagtgagaatccccctaccctcgaaggccgccctaacaacttcccatccgctgacccctccaacgccatcaatctccagctgtggttgttgaactcggaggtgagctcctctcaccactctcttgaataaagcttttctcaccattttaacaa

SEQ ID NO: 1014 - DNA, 2816 bp, Homo sapiens
ctggtccgagggcagcccgaatatgtccctgggtgtgggtatgggtgtggggcaatttgggtgggagcagcgtggaggctcccaggaccaagtcctgcgcctctttggcggggtgtgtgcaggaggaggggggataaataggaggctccctcctcccggcgacattcacggagccggccggcctcccgccctgggtgtttccctgccttgtagccagggtgccagcctgggaagtagtttcgtttccttctgcctccgggattagtttccaggcaccctctcaggcgcccgaggcccgggaagggggcgaagaaggagggagacttgtctaggggctgcccggcccggcagagcggggttgatggaccgggccgcccggtgcagcggcgccagctccctgccactgctcctggcccttgccctgggtctagtgatccttcactgtgtggtggcagatgggaattccaccagaagtcctgaaactaatggcctcctctgtggagaccctgaggaaaactgtgcagctaccaccacacaatcaaagcggaaaggccacttctctaggtgccccaagcaatacaagcattactgcatcaaagggagatgccgcttcgtggtggccgagcagacgccctcctgtgtctgtgatgaaggctacattggagcaaggtgtgagagagttgacttgttttacctaagaggagacagaggacagattctggtgatttgtttgatagcagttatggtagtttttattattttggtcatcggtgtctgcacatgctgtcaccctcttcggaaacgtcgtaaaagaaagaagaaagaagaagaaatggaaactctgggtaaagatataactcctatcaatgaagatattgaagagacaaatattgcttaaaaggctatgaagttacctccaggttggtggcaagctgcaaagtgccttgctcatttgaaaatggacagaatgtgtctcaggaaaacagctagtagacatgaattttaaataatgtatttactttttatttgcaactttagtttgtgttattattttttaataagaacattaattatatgtatattgtctagtaattgggaaaaaagcaactggttaggtagcaacaacagaagggaaatttcaataacctttcacttaagtattgtcaccaggattactagtcaaacaaaaaagaaaagtagaaaggaggttaggtcttaggaattgaattaataataaagctaccatttatcaagcatttaccatgtgctaataagtttgaaatatattatttcctttattcctttcagcaatccatgagatagctattataatcctcatttcctacatatggaaacagggccaaagaagtcaagtcaaataatctaatccagatttagagagttggagattggtagagacagactagaaatcaagatttatctaaatcaaaatctatgctcttaaccatcatttttgttagtctgaatcggtgcaacctaactcaataatataacccaaggttttatactgaactgtgttttggtatgattgtgagatgtcaagaccgtcttcccacaggcacacagaatgagaaatcctggcctatattgctgttaccatcatgctttctatagaattggcttttattatgtttctttgctcctttataaattctcaatgatgtgactacatttttacattattaaagcaaatagattggccccataactagggaaatgaatagagatggaaaagtaaatgcttggcattccttaagccctgggtaagtgtttatgctcaataaaatataaataatattactgaaagaggctgtttatatgggagtaatggtcagtgacaacactggagagaccaggtagggaccggttgtgaccatatcctcatttatgttcttgatgacagcatatatgattgctctcaggtaaattttgatgcagtaaattcatgaccataacatctattacttgggaccatcttgccaagtgctcctttactccatgaaatatttaataaacactgctttaaacctggaaaagcacaatctacatttagtgaatatttcatagaatatttaactttttacattgattacgtggttcacttacaaaaatcgatggaagatgccccccaacttgtgcctgtcggccaagcagcttcttttttagaatctttgcaaattttactttgcaatgtagattccatagtgaagtggagaattcagacaaatgctgaaatcgcatattaccttctagcatccatggtgttttgagtgaagctggggctgtacttacatatgatacataaatagctcccctattagtaaaagctaagccaaacaactgataattttcaaaatctattttttctcctgatttaatggtcatacttgaaacacaattatatccaactgatccatgttgtatatgccttattttcaaaagtctcatttaagctcattcatgccctttctcttatgtagtcttcttcgatacgaaaggagcttggaataaatatccattagagcttttaaaaacacaaaacaatgctttaatgtttcttttttcctggactgagtttggctgaccaacaaaatctctcaagccattttgttttgatcctaaaatatcaatggtggctctcgaaatttggtagatctgatatcaagaaagaatttcaaagatttttatatcttttcaaaatgtattttatagttgctttgcatacactaaataactttgtttatgtaaactgtcaatattatcatgtaataaaataaatttatttttaaaacaaa

SEQ ID NO: 1015 - DNA, 4312 bp, Homo sapiens
ggtcggggcgcggatcccgagagggaaagtcataacaaccgcacgagggagttcgactggcgaactggaaggccacgcctcctcccgcctgccccctcagccctgtggctgggggcagagctcagactgtcttctgaagattgatgtctatttccttgagctctttaattttgttgccaatttggataaacatggcacaaatccagcagggaggtccagatgaaaaagaaaagactaccgcactgaaagatttattatctaggatagatttggatgaactaatgaaaaaagatgaaccgcctcttgattttcctgataccctggaaggatttgaatatgcttttaatgaaaagggacagttaagacacataaaaactggggaaccatttgtttttaactaccgggaagatttacacagatggaaccagaaaagatacgaggctctaggagagatcatcacgaagtatgtatatgagctcctggaaaaggattgtaatttgaaaaaagtatctattccagtagatgccactgagagtgaaccaaagagttttatctttatgagtgaggatgctttgacaaatccacagaaactgatggttttaattcatggtagtggtgttgtcagggcagggcagtgggctagaagacttattataaatgaagatctggacagtggcacacagataccgtttattaaaagagctgtggctgaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagaaaatggttctcctgaagaacatgcaatctatgtttgggatcatttcatagctcaggctgctgctgagaatgtgtttttcgttgctcacagctatggaggacttgcttttgttgaactgatgattcaacgagaagccgatgtaaaaaataaggtaactgctgtggcattgacagactctgttcacaatgtgtggcatcaagaagctggcaaaacgattcgagaatggatgagagagaactgttgtaattgggtctctagctcagaaccattagacacatcagtggagtccatgctacctgattgcccccgggtctcagcaggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcactgcttgtgtcgagcggactcccagcccctcattagattgttttcttcccagagcccagggtcgtgatatatacatctaaatagcgttttgcattatttctagatgagtgcaactgtcaaagcaatatgggttcactggtcgtgcttcctgcgggctgagcgcgggctgagcgctgccagtcagcgctcacattaaggctgacagcgccctgcctggctcggccggcgaagctctaattgccctgaaggagaccgcgcgggcgctgcgggtccggcggcgtcggcgcggtcctagcgcccgccgtagcggagccgctgctgcttccccctccttaatcatgtccatctttccccgctctcaactggagcaaacttctattccagacttcagatttccattttcactaggtttttccctgagggcatcttattacccacctctttttttttttttttaaggaagttccacacacactccaaagccgatttcaaattcagaacctgaatgccatgatgtaccatgtagtttggggaatgcaaattgttctctccctgttttcatttcgggaccagaaaaaaaaacaactctgcataaaaatctataaagtactgaatccgcattactgctgaaaatccttttgccagctaattgtgagagtttacacaagtctctgatttcagaagagactgttaaaaccaaaacaatgatgggcagctcttttaagtgtaggtgtgaaggtcccattttcaatggaatttccaactgttatcactgggattgactttactttttaaacacataatgtgtactgtgtggcattgtaatttagatataacacacttaagttttgctttttaaatctctctgtggagaaaggttgttgttaatcctttccagaatgatctattctgagctttcctggagttaggcccttctagggagagaatttttttattgtcatcaggaaacgaaacctttgtgctctgcagcctttttcttctgaaaggctaagtggggctaaaattatccttttagttttctgctttaacaagaagagaaggacttggtgtgaaagaatttcttctctcagtccaatggtataatttttagcactccgcttcctctgtagggtttagccctacagtttgaacaattattttaatccagctaagatgtggccaacactgtgaaatacaggagatgttaaggttttgctgacttttagattaaaatcttaaaatttcacattatattttaattacttgaaaagtttaattacctagtaaagattgtttctaatagatgagaacataaatttaatagttttcatccttttttaaagtgtgtgcaacaattaatatgcctgccttatttgaggacatgataaaatgtacccaaaatgacttcgaactgtctaatgcctcagaaaagtaacttaaaatcaaccacttcgtgcttaaatgtttttatattatgaaccgatttcaacaagttttaaagctgttaatatctcattgctgtgtttgacatacaagtacattcattggttctatagtcttaatgatgacaaattaaagatgttttttcagtgctcaggtatgcatatattttcgtgttacttaagcaaaatcaactatataggaggaaaaatcaaaatggcattttattcagctaccagatggcttaaaatgagtaaaccccaacaacatcaagcacatttgtctgtgatattgaccctttttatccaatcattactattttagaagtagtggtgaactgtgtaaaataatggtatcttcagcagtgttccggaatcttagttgagggacaaacattccttccagtgagagattcaagaattgatgtgaattgaatatatttttcaaggtattataaattgtgttgtgttttcagtataagaaaatgttgacaggaaacaattttatagcatttataaaaaaccaacacttgtgcaatgctaaattggcgaagcttctgcacctgaattagagcacaataaatatgctgtttataaaccaaatcactgctattccttctctgaaatcatctctcctctttttaaacctttacttatagctagaataaatcactatttaattgcctctaatactttaaaactactggatggttaggcctggtttaactatttatggagagctatttgcaaacttaagttgtgtaaatgtaatttctacttgtgaatctgagctgtagcagcccagagggagctaggcaaactattccagaccaccaactgataagtgatcagattctttgtaatgtaggattttttaacctgttgattatgggtttgttgatataaatgtaataatgttcacctcgattttcctggagtaacaaccagcgttggtagtagcccacctgcatgaggacggccagtgttaacaatatttttgttctgatcttcttccccatttttgtttcctcaaacaggtttttaggagagtggagatttaaagtcaggatgtggcctttttattttaattatatacttaattcttagaacaagtagaatgggaaaggagtgactgataaatctaagattcaaaatagtcccgtcgaaacttaaaggccagattattgctttggagctttctataggtactagccatcccgtcgttaaatgttttcatggatatttgaaaagaagaccatgtacctttaataactgttcttttctcgagtttctgcctcgtgctttgacctggattgcattattattgtttatgcgaagtaaaaaaaaaaaaggaaagcacaagcttttcctgtatattatatttccatttccattttaaaataaaaacaattttcccaacaa

SEQ ID NO: 1016 - DNA, 1319 bp, Homo sapiens
ttataaagctaaagatcacaacttattttctagatatatcatacgaaaatgaaaattataattcttcttggattcctgggagccacattgtcagccccacttatcccacagcgtctcatgtctgccagcaatagcaatgagttacttcttaatcttaataatggtcaacttttgccactacaacttcagggcccacttaattcatggattccacctttctctggaattttacaacagcagcagcaggctcaaattccaggactctcccagttctctttatcagctctagaccagtttgctggactgctcccaaatcagatacccttaacaggagaggccagttttgcccaaggagcccaggcaggccaagttgatcccttacagcttcaaacaccgcctcagacacaaccaggccccagtcacgtgatgccctatgtattctccttcaaaatgcctcaagagcaaggacagatgtttcaatactatccagtttacatggtcctaccctgggaacaacctcagcaaacagttccaaggtcacctcaacaaacaagacagcaacagtatgaggagcagataccattctatgctcaatttggatacattccacaactagcagaacctgctatatcaggaggacagcagcaactagcttttgatccccaactaggcacagctcctgaaattgctgtgatgtcaacaggagaagagataccatatttacaaaaagaagcgatcaactttagacatgacagtgcaggagttttcatgccctcaacttcaccaaaacccagcacaaccaatgttttcacttctgctgtagaccaaactattaccccagagctcccagaagagaaggacaagactgacagcctaagggaaccataagaagttgccctgatcattcagacattttgggaaaaagatgtggccatgccttggatataattttaggctattagcttcctcaatactagtatcagttctttggaatacatgaaatatcttgactcttctcctaaatttgtttttacttatacatgttattaaactctttaaatatgtcatagaaaataatacaatcatgtaatgagtcttgtcttacaaaattatatgtctcttcaaatatcctatcattgtataatatggaatataataacacagaataaagctagtatcattaaatcaattggataattgcattagtaaatgatgcctctgcaaaatggtagtacccatgaagatatgtatattgtcattggatgtatgatgagtgttgtgattggaactgatgaagtaaaataagtatctagatttga

SEQ ID NO: 1017 - DNA, 675 bp, Homo sapiens
ctggaggggtaggtgttctgggggaatgaatccctgggggcttggtgggacaggaaggcgggaagaagctgctcttcgagtgaccctggggctgtctgttagcaggtccctcagccgttggaacgtccttgggcttctgaactagtgcccatgtgtgcctcggcctttcccaagggccagcttcttcctgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctga

SEQ ID NO: 1018 - DNA, 726 bp, Homo sapiens
cggaaccctgtgtgctggggaggaatcccgcagtggccggggggcttgaggccgctgctttgtctcttcgtccagagccttatcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgatt

SEQ ID NO: 1019 - DNA, 1593 bp, Homo sapiens
cctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctgggactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgata

SEQ ID NO: 1020 - DNA, 2272 bp, Homo sapiens
agtgcagcgcagccgcggggagcgaggagcgcgcggagccggccatgggcaagtcagaatctctacagagcctccagcggtagaggcctggcctccagaaggaacttcgagaacccagtgcagccccacctaggacacctataccctccaccccagcagagacagcccagccccttccctcagccctggggagccaggcccagggcttttagcagctctgacctttattttaagtcccaagtctggccccctggtaacctgcactctgcagtccctgatatccccctggggtccctcagccagaaattccatgggatttgacttggcccaggagacatgggagatctggctatgagaaaagggactaggactccctgttgcatcatctcctcagtctcgggtgaaaggcagcagagtagaagaaaggcaccagtgaagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggaaaggaggtggctgatagatggtacagtgaaatcaagaactataacttccagcagcctggcttcacctcggggactggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgt

SEQ ID NO: 1021 - DNA, 4484 bp, Homo sapiens
aggactcaggaagagatagacccataatgatgctgcctcaaaactcgtggcatattgattttggaagatgctgctgtcatcagaaccttttctctgctgtggtaacttgcatcctgctcctgaattcctgctttctcatcagcagttttaatggaacagatttggagttgaggctggtcaatggagacggtccctgctctgggacagtggaggtgaaattccagggacagtgggggactgtgtgtgatgatgggtggaacactactgcctcaactgtcgtgtgcaaacagcttggatgtccattttctttcgccatgtttcgttttggacaagccgtgactagacatggaaaaatttggcttgatgatgtttcctgttatggaaatgagtcagctctctgggaatgtcaacaccgggaatggggaagccataactgttatcatggagaagatgttggtgtgaactgttatggtgaagccaatctgggtttgaggctagtggatggaaacaactcctgttcagggagagtggaggtgaaattccaagaaaggtggggaactatatgtgatgatgggtggaacttgaatactgctgccgtggtgtgcaggcaactaggatgtccatcttcttttatttcttctggagttgttaatagccctgctgtattgcgccccatttggctggatgacattttatgccaggggaatgagttggcactctggaattgcagacatcgtggatggggaaatcatgactgcagtcacaatgaggatgtcacattaacttgttatgatagtagtgatcttgaactaaggcttgtaggtggaactaaccgctgtatggggagagtagagctgaaaatccaaggaaggtgggggaccgtatgccaccataagtggaacaatgctgcagctgatgtcgtatgcaagcagttgggatgtggaaccgcacttcacttcgctggcttgcctcatttgcagtcagggtctgatgttgtatggcttgatggtgtctcctgctccggtaatgaatcttttctttgggactgcagacattccggaaccgtcaattttgactgtcttcatcaaaacgatgtgtctgtgatctgctcagatggagcagatttggaactgcgactagcagatggaagtaacaattgttcagggagagtagaggtgagaattcatgaacagtggtggacaatatgtgaccagaactggaagaatgaacaagcccttgtggtttgtaagcagctaggatgtccgttcagcgtctttggcagtcgtcgtgctaaacctagtaatgaagctagagacatttggataaacagcatatcttgcactgggaatgagtcagctctctgggactgcacatatgatggaaaagcaaagcgaacatgcttccgaagatcagatgctggagtaatttgttctgataaggcagatctggacctaaggcttgtcggggctcatagcccctgttatgggagattggaggtgaaataccaaggagagtgggggactgtgtgtcatgacagatggagcacaaggaatgcagctgttgtttgtaaacaattgggatgtggaaagcctttgcatgtgtttggtatgacctattttaaagaagcatcaggacctatttggctggatgacgtttcttgcattggaaatgagtcaaatatctgggactgtgaacacagtggatggggaaagcataattgtgtacacagagaggatgtgattgtaacctgctcaggtgatgcaacatggggcctgaggctggtgggcggcagcaaccgctgctcgggaagactggaggtgtactttcaaggacggtggggcacagtgtgtgatgacggctggaacagtaaagctgcagctgtggtgtgtagccagctggactgcccatcttctatcattggcatgggtctgggaaacgcttctacaggatatggaaaaatttggctcgatgatgtttcctgtgatggagatgagtcagatctctggtcatgcaggaacagtgggtggggaaataatgactgcagtcacagtgaagatgttggagtgatctgttctgatgcatcggatatggagctgaggcttgtgggtggaagcagcaggtgtgctggaaaagttgaggtgaatgtccagggtgccgtgggaattctgtgtgctaatggctggggaatgaacattgctgaagttgtttgcaggcaacttgaatgtgggtctgcaatcagggtctccagagagcctcatttcacagaaagaacattacacatcttaatgtcgaattctggctgcactggaggggaagcctctctctgggattgtatacgatgggagtggaaacagactgcgtgtcatttaaatatggaagcaagtttgatctgctcagcccacaggcagcccaggctggttggagctgatatgccctgctctggacgtgttgaagtgaaacatgcagacacatggcgctctgtctgtgattctgatttctctcttcatgctgccaatgtgctgtgcagagaattaaactgtggagatgccatatctctttctgtgggagatcactttggaaaagggaatggtctaacttgggccgaaaagttccagtgtgaagggagtgaaactcaccttgcattatgccccattgttcaacatccggaagacacttgtatccacagcagagaagttggagttgtctgttcccgatatacagatgtccgacttgtgaatggcaaatcccagtgtgacgggcaagtggagatcaacgtgcttggacactggggctcactgtgtgacacccactgggacccagaagatgcccgtgttctatgcagacagctcagctgtgggactgctctctcaaccacaggaggaaaatatattggagaaagaagtgttcgtgtgtggggacacaggtttcattgcttagggaatgagtcacttctggataactgtcaaatgacagttcttggagcacctccctgtatccatggaaatactgtctctgtgatctgcacaggaagcctgacccagccactgtttccatgcctcgcaaatgtatctgacccatatttgtctgcagttccagagggcagtgctttgatctgcttagaggacaaacggctccgcctagtggatggggacagccgctgtgccgggagagtagagatctatcacgacggcttctggggcaccatctgtgatgacggctgggacctgagcgatgcccacgtggtgtgtcaaaagctgggctgtggagtggccttcaatgccacggtctctgctcactttggggaggggtcagggcccatctggctggatgacctgaactgcacaggaatggagtcccacttgtggcagtgcccttcccgcggctgggggcagcacgactgcaggcacaaggaggacgcaggggtcatctgctcagaattcacagccttgaggctctacagtgaaactgaaacagagagctgtgctgggagattggaagtcttctataacgggacctggggcagcgtcggcaggaggaacatcaccacagccatagcaggcattgtgtgcaggcagctgggctgtggggagaatggagttgtcagcctcgcccctttatctaagacaggctctggtttcatgtgggtggatgacattcagtgtcctaaaacgcatatctccatatggcagtgcctgtctgccccatgggagcgaagaatctccagcccagcagaagagacctggatcacatgtgaagatagaataagagtgcgtggaggagacaccgagtgctctgggagagtggagatctggcacgcaggctcctggggcacagtgtgtgatgactcctgggacctggccgaggcggaagtggtgtgtcagcagctgggctgtggctctgctctggctgccctgagggacgcttcgtttggccagggaactggaaccatctggttggatgacatgcggtgcaaaggaaatgagtcatttctatgggactgtcacgccaaaccctggggacagagtgactgtggacacaaggaagatgctggcgtgaggtgctctggacagtcgctgaaatcactgaatgcctcctcaggtcatttagcacttattttatccagtatctttgggctccttctcctggttctgtttattctatttctcacgtggtgccgagttcagaaacaaaaacatctgcccctcagagatgacacccccaaccatggttgtgaagatgctagcgacacatcgctgttgggagttcttcctgcctctgaagccacaaaatgactttagacttccagggctcaccagatcaacctctaaatatctttgaaggagacaacaacttttaaatgaataaagaggaagtcaagttgccctatggaaaacttgtccaaataacatttcttgaacaataggagaacagctaaattgataaagactggtgataataaaaattgaattatgtatatcactgtt

SEQ ID NO: 1022 - DNA, 1592 bp, Homo sapiens
aggatgccctcccagttcctcctgcctctaggttcctctttccctgctgattccaggagcctatcaacccagataaagcgggacctcctctctggtagaggtgcagggggcagtactcaacatgatcacagagggagcgcaggcccctcgattgttgctgccgccgctgctcctgctgctcaccctgccagccacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctgagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccacacacggggcctgggccacctggggcccctggaccccctgctcagcctcctgccacggtggaccccacgaacctaaggagacacgaagccgcaagtgttctgcacctgagccctcccagaaacctcctgggaagccctgcccggggctagcctacgagcagcggaggtgcaccggcctgccaccctgcccagtggctgggggctgggggccttggggccctgtgagcccctgccctgtgacctgtggcctgggccagaccatggaacaacggacgtgcaatcaccctgtgccccagcatgggggccccttctgtgctggcgatgccacccggacccacatctgcaacacagctgtgccctgccctgtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgccccttgaaaggatcatggtcagagtggagtacctgggggctgtgcatgcccccctgtggacctaatcctacccgtgcccgccagcgcctctgcacacccttgctccccaagtacccgcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaactagcctcttcg

SEQ ID NO: 1023 - DNA, 1647 bp, Homo sapiens
tcctctgctgggcctgggggtctgggccagcaacaagttagtattgcagacatgggccaaggagccagaggccatgcagtggctcagggtccgtgagtcgcctggggaggccacaggacacagggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgaggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttgg

SEQ ID NO: 1024 - DNA, 2398 bp, Homo sapiens
gagacggctgcagaccatggggcagggagcatatggagcacggatatgccagacagagggatgattcatatcccaggcaggatggagcagggcagtgtgctatttcatcgtgctactcagaacttatgaattgtttatttctggaatttcccatttaatatttttggactgtggttgatcgagggtaaatgaaattgcagaaagcaaaaatacagataagggggactgcttgctgtacaaagatagagacaagaggaaggagctgtcctcaagggccttttgtgtgaagacatctggcacacagatacgctgcatgcaggtggcttgagagaacatgcatccaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcaggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcagagggaggcttcacacagattaagtgcaacacagacattttcattggcggagtccccaattatgatgatgtgaagaagaactcgggtgtcctgaagcctttcagcgggagcatccagaagatcatcctgaatgaccgaaccatccatgtgaagcatgacttcacctccggagtgaatgtggagaatgcggcccacccctgtgtgagagccccttgtgcccatgggggcagctgccggcccaggaaggagggctatgactgtgactgccccttgggctttgaggggcttcactgccagaaagcgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatcaaa

SEQ ID NO: 1025 - DNA, 1299 bp, Homo sapiens
gacgttctggactctcgggcagagctttgtgagagaaacaaggctggcttcaagtgatctgcaaccagagtaattgggatttgacaaggactgtgaaaggctgactctccctgttctctttcatgctggcaccgggcagagtgtgggaactactgcctcaatacgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatcaaacacagaa

SEQ ID NO: 1026 - DNA, 1548 bp, Homo sapiens
cgcaccaagcgggtggctgcaggagctcgcccatcgcccctgcgctgctcggaccgcggccacagccggactggcgggtacggcggcgacagacggattggccgagagtcccagtccgcagagtagccccggcctcgaggcggtggcgtccgcgtcctctcgtccaggagccaggacaggtgtcgcgcggcgggcgctccagggaccgcgctgaggccgcggtcgccgcccgtcccgccccgccccgccgcccgccgcccgccgagcccagcctccttgccgtcggggcgtccccaggccctgggtcggccgcggagccgatgcgcgcccgctgagcgccccagctgagcgcccccggcctgccatgaccgcgctccccggcccgctctggctcctgggcctggcgctatgcgcgctgggcgggggcggccccggcctgcgacccccgcccggctgtccccagcgacgtctgggcgcgcgcgagcgccgggacgtgcagcgcgagatcctggcggtgctcgggctgcctgggcggccccggccccgcgcgccacccgccgcctcccggctgcccgcgtccgcgccgctcttcatgctggacctgtaccacgccatggccggcgacgacgacgaggacggcgcgcccgcggagcggcgcctgggccgcgccgacctggtcatgagcttcgttaacatggtggagcgagaccgtgccctgggccaccaggagccccattggaaggagttccgctttgacctgacccagatcccggctggggaggcggtcacagctgcggagttccggatttacaaggtgcccagcatccacctgctcaacaggaccctccacgtcagcatgttccaggtggtccaggagcagtccaacagggagtctgacttgttctttttggatcttcagacgctccgagctggagacgagggctggctggtgctggatgtcacagcagccagtgactgctggttgctgaagcgtcacaaggacctgggactccgcctctatgtggagactgaggacggagagacgtggactggctggggctggaccaaggactccaggcttcagatgtggaaactgaggctcagcaggaccccttgggtcctcagcctccacgctcctggacctgcccaggccccggcagagagaccgctgctgtgtctgctgcagggccactgcccggccagtccgagtcccatccgcacccctcgggcagtgaggccactgaggaggaggcagccgaagaaaagcaacgagctgccgcaggccaaccgactcccagggatctttgatgacgtccacggctcccacggccggcaggtctgccgtcggcacgagctctacgtcagcttccaggacctcggctggctggtaattgctgactcttcttgtttctgaaatgacaatcaccacctgtagatcagaagtgaatctgcagggaggacatagaatcatggtgacttcaattttcttatgtatttttttcttctgtgttttccaagttttctaaagtgagaatatggtgagaaagg

SEQ ID NO: 1027 - DNA, 1949 bp, Homo sapiens
cgaatacaaagagccatacgaccttcggtttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctg

SEQ ID NO: 1028 - DNA, 899 bp, Homo sapiens
accaacctgggcaacatagcaagaccccgcctcttaaaaaaaaaaagattaaggaatcaggtttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgaggg

SEQ ID NO: 1029 - DNA, 1986 bp, Homo sapiens
cggctcgggctccgcgagtcctcctttttgcacacacacgaatacaaagagccatacgaccttcgggtatcctttttccattttttttcctccttaatcttgtgtgtgttttcaaattttttaaaaatagagatctgtagcagtgttgggaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagat

SEQ ID NO: 1030 - DNA, 2091 bp, Homo sapiens
atcttggctttttagcagctgagtttaaggcgcaaggtggagaacacatcagcttcaaaggcagagagaatcgaaggtgctctccagctttggacacttcctctgcttgagatgtgtacaaagacaatcccagtcctctggggatgtttcctcctgtggaatctctatgtctcatcctctcagaccatttaccctggaatcaaggcaaggattactcagagggcacttgactatggtgttcaagctggaatgaagatgattgagcaaatgctaaaagaaaagaaactcccagatttaagcggttctgagtctcttgaatttctaaaagttgattatgtaaactacaatttttcaaatataaaaatcagtgccttttcatttccaaatacctcattggcttttgtgcctggagtgggaatcaaagcgctaaccaaccatggcactgccaacatcagcacagactgggggttcgagtctccacttttccaagacacaggaggggctgatctgtttctctccggagtctactttaccggtatcattatcctaacccgaaatgactttggtcatcctaccctgaagctccaagattgctacgcccaactgagccatgcccacgtctcattttccggagaactcagtgttctgtataactcctttgctgagcccatggagaaacccattttaaagaacttaaatgaaatgctctgtcccattattgcaagtgaagtcaaagcgctaaatgccaacctcagcacactggaggttttaaccaagattgacaactacactctgctggattactccctaatcagttctccagaaattactgagaactaccttgacctgaacttgaagggtgtattctacccactggaaaacctcaccgacccccccttctcaccagttccttttgtgctcccagaacgcagcaactccatgctctacattggaatcgccgagtatttctttaaatctgcgtcctttgctcatttcacagctggggttttcaatgtcactctctccaccgaagagatttccaaccattttgttcaaaactctcaaggccttggcaacgtgctctcccggattgcagagatctacatcttgtcccagcccttcatggtgaggatcatggccacagagcctcccataatcaatctacaaccaggcaatttcaccctggacatccctgcctccatcatgatgctcacccaacccaagaactccacagttgaaaccatcgtttccatggacttcgttgctagtaccagtgttggcctggttattttgggacaaagactggtctgctccttgtctctgaacagattccgccttgctttgccagagtccaatcgcagcaacattgaggtcttgaggtttgaaaatattctatcgtccattcttcactttggagtcctcccactggccaatgcaaaattgcagcaaggatttcctctgtccaatccacacaaattcttattcgtcaattcagatattgaagttcttgagggtttccttttgatttccaccgacctgaagtatgaaacatcctcaaagcagcagccaagtttccacgtatgggaaggtctgaacctgataagcagacagtggagggggaagtcagccccttgattgccggtttgcaattcaccccaggaagtaaatggtccttaatcctacaactactgtaaacccagaagggaaagacagtacacactggaattgtaaagcccttgtgaattgcttaggcagaaagttttctttcttaagccttcaggaacccagaataaggcagactctgttaaagggataaatagaggtgtctgaatgtgagtgtatgcatgctgcgtgtgtctgtgtttatgtttgtttgtttgtttggggcaagaaagattctaggacaagagctaggcatgtacttctgaccaggtgggtaagcaactctaagtctgtatttgtattggtcattctcagtggaaatcccttaggccctctagtggttttcccctacctgcatattggttttcatgttttatattcactgttactatcttctgtgtttaattaaaattgttttctatcaacttc

SEQ ID NO: 1031 - DNA, 790 bp, Homo sapiens
gcccgagccatggcgtccgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgccgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtggagcagcagcctcctgccccaaggccgaccggcactggcagcactttcctgttgaagaaatcttcctggcgtgtggtttcaaagtggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagcatgcaaa

SEQ ID NO: 1032 - DNA, 1722 bp, Homo sapiens
cgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggca

SEQ ID NO: 1033 - DNA, 1864 bp, Homo sapiens
ggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagg

SEQ ID NO: 1034 - DNA, 2014 bp, Homo sapiens
cctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggca

SEQ ID NO: 1035 - DNA, 1951 bp, Homo sapiens
atccgccccctgcctcatccaggcttcgccccagtcagtctccggcagcttctcgcggcttcgcaagccccttcccgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgggtctcactctgtcactcaggctggagtatagtggcatgatcacagctcactgcagcctcgacctcctaggctcagttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataagactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaagcattttgttttgcaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagc

SEQ ID NO: 1036 - DNA, 1680 bp, Homo sapiens
atgtgccagctcctggagtccacagtgatccaacctcaaggggacagccccgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataagatgtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaact

SEQ ID NO: 1037 - DNA, 1879 bp, Homo sapiens
gcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcaggccaggcgtactggttcacacctgtaatcccagcactctgggaggccgaggcgagaggatcacttgaggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagc

SEQ ID NO: 1038 - DNA, 2042 bp, Homo sapiens
ctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactcacattttactccaggactttcacggtggctgtgtgagagtagaagtcggattctttcattcccatagccatccggagagagcttctccttacaggttgatacagcaaactcatcagtccaggggctagagaaatagacggattattattggcttctgttgtgctgtttacttataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaact

SEQ ID NO: 1039 - DNA, 1885 bp, Homo sapiens
cgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaagcattttgttttgcaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagc

SEQ ID NO: 1040 - DNA, 2148 bp, Homo sapiens
gcaaaccttaagctgaatgaacaacttttcttctcttgaatatatcttaacgccaaattttgagtgcttttttgttacccatcctcatatgtcccagctagaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatatcaaatacagaacatgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaaggtcagatggaacccaggacccatccaacttggctgcttcacattttcatccccttctgcatcattgctttcattttcatagccacagtgatagccctaagaaaacaactctgtcaaaagctgtattcttcaaaagacacaacaaaaagacctgtcaccacaacaaagagggaagtgaacagtgctatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaacgttctttatatattctacttttgggta

SEQ ID NO: 1041 - DNA, 2363 bp, Homo sapiens
ttttcttctcttgaatatatcttaacgccaaattttgagtgcttttttgttacccatcctcatatgtcccagctagaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatatcaaatacagaacatgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatccccttctgcatcattgctttcattttcatagccacagtgatagccctaagaaaacaactctgtcaaaagctgtattcttcaaaagacacaacaaaaagacctgtcaccacaacaaagagggaagtgaacagtgctatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttc

SEQ ID NO: 1042 - DNA, 680 bp, Homo sapiens
acatacatcgggtgtgagcacggaatagctgggcggcggctggtccacagacactgggagacagaaggggccggtcctcaggcgcccgtgctgcagcagtgggatccactggggagaggctggagatggaggaggatattctgcagctgcaggcagaggccacagctgaggtgctgggggaggtggcccaggcacagaaggtgctacgggacagcgtgcagcggctagaagtccagctgaggagcgcctggctgggccctgcctaccgagaatttgaggtcttaaaggctcacgctgacaagcagagccacatcctatgggccctcacaggccacgtgcagcggcagaggcgggagatggtggcacagcagcatcggctgcgacagatccaggagagactccacacagcggcgctcccagcctgaatctgcctggatggaactgaggaccaatcatgctgcaaggaacacttccacgccccgtgaggcccctgtgcagggaggagctgcctgttcactgggatcagccagggcgccgggccccacttctgagcacagagcagagacagacgcaggcggggacaaaggcagaggatgtagccccattggggaggggtggaggaaggacatgtaccctttcatgcctacacacccctcattaaagcagagtcgtggcatctc

SEQ ID NO: 1043 - DNA, 2013 bp, Homo sapiens
ggatggagggttgaatgccaaaacttcgtaatcgtagaaaattctggaaagccgccggcggggcaaggccacgaggatcctcctcgcagcaccgcgccgcgcggggcccaggggccgcgctcacgcccgccgctcggcgcagacacgagtgcccccgacttgagccgaacctctagccgatgccggcgccgccgccgccggggatgcgtaagccgactgggaagcgagggggggaggcggcctgcgcggcaccgcccgacctggccgcggcgggctgagccccaggttccggaggaatgctcgctccccgctggagtcctaccagcccaacacggacctgagccgcgaccacgcgggctgcagcctgcagcacatcagctacccggagaacgcggacgcggaagcaccgctgctcagcacccccgaagaaacacggaatccagagaggcacaggcaccgccccggcgcgcacagctgcactcagcggcttccttcctactacatacatacataggagtgggagccgaggaccacttgttgcttgcggacttcctctagcataaaagatggaaagaaaacacacaccgaagcaagggaccaaaggaacagaaaagaaacgcagagatcataggaaaactgcaaagaaatacttgataatatcttccaaacgattagagaagacataacattcattaagaatacacatatagatgtatatatacgtatgaagaaaacctgcttgatatcacacagtcaggagtcaactgagttggggctttgaacttaggtttatctgatgccaaagtttgtgatgctcttcaaccatttagggtaccgcagagtgtggattttgaatcacctgcatcagcatcattttaaaatatagattctgtggtcctgaccaggtctctgaagtcagaatatgaagtggagctaggaatctaacttcttaacaagttccctagatgcctaagggtatccctgaatgatacagttttgtttgaaagactgaaaagcccaaagctggcccttttgggaaatagcagtaaatcattgatatgtgaaggttcccagcaggaggatgaaaatttacaggaattcggaggaaaatatttcagtggtcattactaaaacgctcagagtcagatacattcagcatcataccgtaagtcccgttagtcaaagcataaacaagcgcagggcctggcatggcttccttcaagttggctgactcagtctgggaggattcactcagcaagaggcagaggaaccaaggcaggatgaagacattgcctgtgctcgtgctgtctcttaccttactgactgtcttctcagagacctccccgattttgacagagaagcaggccaaacagctcctaagatctcggcgacaggatagaccaagcaaacccggattccccgatgagccaatgcgggaatacatgcaccacctgctcgccctggagcatcgcgctgaggagcagttcctggagcactggctgaaccctcactgcaaaccccactgtgacaggaacaggattcatcctgtgtaaggggatcaggaccagcctcgcaagcattttaatagacaacaagctggataatgtcgaagcaagacaaggctgcttctttcacttgtttttaaattgcagaaatggatgtcttcagacctcgtgaactgtgggcatatcaaagattgccttggaaatggcaaatatatatactgcttcattttactaacctgcatagatcactaaaaccaatagcttaaagcatagacacctcccaaaggtcttcccatcagtttgcaagagtgggaacaaccagaatcttacctggggttgatggagctggaactcccagaccaggagttggggcaggctgcctgccctaaggaatttggggaatccttgttcagagtagtgaagcataccacttggggttgctgagttgttttgtcctctatttttttcctcttcttttctgccctaataaacattggtattaaattta

SEQ ID NO: 1044 - DNA, 811 bp, Homo sapiens
gcctggcatggcttccttcaagttggctgactcagtctgggaggattcactcagcaagaggcagaggaaccaaggcaggatgaagacattgcctgtgctcgtgctgtctcttaccttactgactgtcttctcagagacctccccgattttgacagagaagcaggccaaacagctcctaagatctcggcgacaggatagaccaagcaaacccggattccccgatgagccaatgcgggaatacatgcaccacctgctcgccctggagcatcgcgctgaggagcagttcctggagcactggctgaaccctcactgcaaaccccactgtgacaggaacaggattcatcctgtgtaaggggatcaggaccagcctcgcaagcattttaatagacaacaagctggataatgtcgaagcaagacaaggctgcttctttcacttgtttttaaattgcagaaatggatgtcttcagacctcgtgaactgtgggcatatcaaagattgccttggaaatggcaaatatatatactgcttcattttactaacctgcatagatcactaaaaccaatagcttaaagcatagacacctcccaaaggtcttcccatcagtttgcaagagtgggaacaaccagaatcttacctggggttgatggagctggaactcccagaccaggagttggggcaggctgcctgccctaaggaatttggggaatccttgttcagagtagtgaagcataccacttggggttgctgagttgttttgtcctctatttttttcctcttcttttctgccctaataaacattggtattaaattt

SEQ ID NO: 1045 - DNA, 853 bp, Homo sapiens
gtacacacactcacacaaggacgccaaccccacctagatgcaaagcaggattcaaaagaacatctttgcgttttctaccggctccccatcatcgtactagggaggaagaagcgggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatg

SEQ ID NO: 1046 - DNA, 4655 bp, Homo sapiens
ctctttggccaagccctgcctctgtacagcctcgagtggacagccagaggctgcagctggagcccagagcccaagatggagccccagctggggcctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaagaaataagatctgacaactggctggcttcccaccttggactgcctcccgattccttgctttcttatcctgcaaattactcagatgattccaaaatctggcgccctgtggagatctttagactggtcagcaaatatcaaaacgagatctcagacaggagaatctgtgcctctgcatcagccccaaagacctgcagcattgagcgtgtcctgcggaaaacagagaggttccagaaatggctgcaggccaagcgcctcacgccggacctggtgcagggcctggccagcccgctcctgcgctgcccttcgcagcgactcctggatcgcgtggtcaggcgctatgcagaggtggccgacgccggcagcatcttcatggaccacttcaccgaccgtgacaagctgcgcctgctctacacgctggctgtcaactcgcaccccatcctcctacagatcttccctggggctgagggatggccgctgcccaagtacctgggctcctgtggcagattcctcgtcagcaccagcaccagaccgctgcaggaattctatgatgcacccccagatcaggcagccgaccttgcctaccagctcctgggtgtcctggagtctttgaggagcaacgatttgaactatttcttctacttcacccacattgatgcaggcatgttcggcgtctttaacaacgggcatctgttcatccgggatgccagtgcagtgggcgtcatcgacaagcaggaaggcagccaagaagccaacagggcaggagagaataaagacatttttagctgcctggtttccggctgccaggcccagctgccctcctgcgaaagcatctctgagaagcagagcctggtgctggtgtgtcagaagttgctgcctcgacttctccaggggaggttcccctccccagtgcaagacgacatagactccatccttgttcagtgtggggacagcatccgcccagacccagaagtccttggggccgccagccagctgaaagacatcttgaggcccctgagaacgtgtgactccagatttgcctatcgttacccagattgcaaatataacgataagttctgaagggctggtgtctagctggccttggggacaacacgcttggctctccattctcccagtcgggttgctgcaaggtagaaagaagcagctcttttttaaagatgagaagaaaggcacactcatttcttagggactgagaggggagttgtgagataccacgtggctgtctctgctggctgggacgtcctggcaaagcccgcggtgggcatcagaagacctgggtgtggacgctcactcaatgtctttgagcctcagtttcctctgttctccaccagactctcctgagggtgaaagaagacacagatggagccaccactgagcatatatcccaagcatgggtcttgggacacatgctcaccacctccatcccaggtggttacaaagtgtgttctggaaaagcacagaggcggggagcatgagaaagagctgctcaggtcaggaggctggagtggagggaaggcaggggaaggacaggctccctgccactaccactttagactcggacaagaggggcccccttcctgctccctatggccctgcgtcactccccacaccatcgcgggatgaggagactgcaggccaaggggacatgcctgccaccacctagagcctggtacctgaggctccatacacctgcgcatggggcttctcgtggtgtgggaagaagccaggggtaagaagataaaggggggccggcgggggaccaatgtgttagcccaagtcttccaagaatatgtgtcaagatagagtgaatggaacaaagatttgttaggggaaatgattgtgtgtaaggaaagaaggagggagccggagaagattgggaggaccagtaagtcgagctgcaagctgagccccggtgaaggagagaatgtctggcaggagcttgctaagctcaaaatcaaagaaaggttcagcaaggctgtcagggtgtcctcaagacaaaggcagccatcagaagagccccgtgtctcccacaaatagaccccgttagcatccctgctgcactcagtggttggcggaaacagcaaagatagatttcagagcacagcagcaggggtccctggtcagccccgctccctagagcaggagatcttgagtgggagaacattcttgttgtagccacagctgaggccctggaccagctctctccacaccgcatgctccgagttgggactctaaggagtctaggaattttcattcaaacttggccttacaggtcactcatcagaaaaatacttttttcaaggtcaaccaatagaacatactttattcaacagtttgttagtttgctttttaaatatttagccacatggtatgtaggcttccatgtacactcttgccctggcccctgaaacataagcagggggctcttctgtacatttgcccagcttccctgccagcctttaaccccaggaacctctcagtctacctcctcttttctgcctctgaatccctacctttaaagtcagaacaggccaggcccggtggctcacgcctgtaatcccagcactttgggaggctgaggtgggtggatcacttgacatcagtagttcaagaccagcctggccaacatggtgaaaccccatccttactaaaaatacaaaaattagccaggtgtggtggcgggcacctgtaatcccagctactcaggaggctgaggcaggagaatcacttgaacccaggaggcagagtttgcagtcagccaagatcacgccactgtactccagcctggatgacacagcgagactccgtctcaaaataaataaataaaaataaagtcagaacacctggcttaataggcctcactgtgcagatgaggaaactgaggcccagggaggaagagcgatctgtggagatatttctagaacccctgcaagctgagccccagtgaaggagagaaggtccagtaggagcttgctaagctcaaaatcgaagaaaggttcagcaagactgtcagggtgacctcaaagcaatggcagccatcagaggagccccattgctattaggaggctcctattgccctccccttcagcctctgactttcacctgtgctacccaattctggttccttcactcccattcaaaaatggaccccagaaaagccttattttgtggagtacctagttcccttttgggtttgtctcttgactgctacgggcattgccccagggcaaccatgacagtgaagatgactggccaagcttgtggactggccagcaagcttgggctgcctgagacgctttgaaatggctgccttctgagttggtcttgagggtgaagactgaccacccttctcacctgcacagtcacagtccctctcctgctggcctgactgcagctgtcctcccagctggccacctgaccagagaccaggagagaggccacagcctccagaccctccagagtcccacggaggaagaaggcttaccagagagaccctctgatgcatgagccaggccccagcccttctccctgcatccaggtgtgtttccaccgcaaaatgcctccacacaatgagcgactttggccctgcgtgggtcagcatgtggtctgaggtaaccctcaaatgcctccaccacacatctgtccacctgcacgggttcaaggtaagcacttgcccccttctctcctccagaccagtcgcctgaaattctgagcaacattccttcaagactatcatgtaacccttggtgatgctgagtccagacaggaaatgcagacttgggacccacctgtatcagcagaaagaggccttgtgccccgtttgtccgagtcccagaacggagcaaatgagaaaaccggcgagctgtcccccgaggagctgtagggagattggtttttagtataaattacaataaaattttgtgtatgtgtacagctgtgttcacatccacagtgtaagctgtgatatggtttggatgtttgtcccctccaaatctcatgttgaaatgtgatccccagcattggaggtggggcctgatgggaggtgattgggtgatgggggaagttgcctcatgaatgacttggtgccctcctggaagtgatgagtgagttctcgctgagctcactcaagatgtggttgtttaaaagagtgtggcacgtccctcccccaactctccctctcactcccgctctcaccatgtgacacacctgctcccccttcgccttccaccatgattggaagcttcctgaagcccttaccagaagcagatgccagccccacacttcctgtaccacctgcagaaccataaaccaaaataaagctcttttctttatcaatt

SEQ ID NO: 1047 - DNA, 872 bp, Homo sapiens
gagcaggcatgggtgggtcacaggctttggagagcactctctgtcctgatcttttcagttgagagacttcagctgttcattgctcatttggacttagttcaagaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatcta

SEQ ID NO: 1048 - DNA, 1034 bp, Homo sapiens
agctatggcatttcaatcctgtatgtgagagctagagactcatacagtgacctagagcaggcatggaattttgggtgtcaccaggtaaacagagccctcagcatctgaatagaaactgaacaggaacagttagacacaacagcagaaactcccaggaaacaaacacgatttcacttttagctctgcaacaaagtggaatcttcctctacaggatcaacttgccgaaggaactgaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactga

SEQ ID NO: 1049 - DNA, 624 bp, Homo sapiens
atgctgccttgcctcgccctgcttctcctgatggagctgtccgtgtgcactgtggcaggtgatggtggagaggaacagacactcagcactgaagcagagacctgggaaggcgctggccccagcattcagctccagctgcaggaggtgaagacgggcaaggcaagccagttctttgggctgatggggaagcgagtgggagcatatcagctggaacacacgttccagggcctcctgggcaagagaagcctgttcacagaaggcagagaggatgaggcccaaggttcagagtaaaagcccccaccacagacttcccagaggacacggtgccgcttcttcctacctggatgtcacagctgacaagccggcaggccaactctcttctctgtgtctcctgtcctcatcgctggcacttcacacaaggcccacactgaacccactgggcttcttcctggactctcagtgtcaagcagcagtcctgcataaatgcacagcttcgccgtagcaagctgcactgactctgccctccctcacactcagagttggcatctcactgcacagcagtgaggagactcgcacactctgtatcctgtgcctagcacacagtaggcactcaataaatgagtg

SEQ ID NO: 1050 - DNA, 1715 bp, Homo sapiens
cctttcctcatgggacacagaactaggcagaacaggatcaggaagcgatcaaacctaccaaggcagtctcacttctcaatgactggactgtgtgggtactctgctccagacatgcgtggcctcagactcatcatgataccagttgagctgctactttgctacctcctgctgcaccctgtggatgccacttcatatggaaagcagacaaatgtcttgatgcactttcccttgtccttggaatcccagacaccctcctcagaccccttgtcctgccaatttctgcacccaaagtcactgcctggtttcagccacatggcccctctacccaagttcttggtaagcctggctctaaggaatgccctggaggaagctggttgtcaggctgatgtttgggctctacagctacagctctaccgccagggtggtgtgaatgctacacaggtcctcatccagcatcttcgagggctccagaaaggcagaagcacagagaggaacgtgtcagtggaagccctggcctctgctctgcagctgttagccagggagcagcaaagcacaggaagggtcgggcgctccctcccgacagaggactgtgagaatgagaaggagcaagctgtgcacaatgtagtccagctgctgccaggagtgggaaccttctacaacctgggcacagctttgtattatgctactcaaaactgcctgggcaaggccagggaacgaggccgagatggggccatagatctgggatatgaccttctgatgaccatggctgggatgtcaggggggcctatgggtctagcgatcagtgctgcacttaaacctgcattaaggtctggggttcagcagttgatccagtattaccaagatcagaaagacgcaaacatctctcagccggagaccaccaaggagggtttgagggccatctcagatgtgagtgacttggaagaaacaactactctggcttctttcatatcagaagtagtaagttcagctccctactgggggtgggccataatcaagagctatgacttagatcctggggctgggagtcttgagatataaaagaatgtggtaaccacagaattaataactgtactaccctgacaagctatatacatgtcttcaaaattttaatctgatttatccaggaggaaggctgtacagtaaaacgtaagaacgtaaatgtttgggtgttgaagtcacagggtttggtttcgaatctaggctccacttgttagagcctcggtgatcactgaatagtaacttctttcttgaactaagatcagttttgaagtttctaaaggagatagaatgattttaacctcaatgagttgccctgtaaatttaaaatgatacaatgaatctaaaatgcttatcacagtactttcaataaatagctattagccaggtgcggtggctcacgcctgtaatcccagcactgtgagaggctgaggcgggatgatcacctgaggtcaggagttcaagatcagcctgggcaacatggcgaaaccccgtctctacaataaatacaaaaaattatcctggcggagttatgcacgcttgtagtcccaactacctgggaggctgaggcgggagaatcacctgagcctgggaggtcgaggctgcagcgagccgagatcgcgccgctgcattccagcctgggtgacagagcgagaccatgtctcaaaaaataaaaataaaaaaaaattgttttcatt

SEQ ID NO: 1051 - DNA, 2135 bp, Homo sapiens
agtgttgccatcactcctgcccacagcaggagctggctggagcatgaggtggattctgtgctggagcctcaccctctgcctgatggcgcagacggccttgggtgccttgcacaccaagaggcctcaagtggtcaccaaatatggaaccctgcaaggaaaacagatgcatgtggggaagacacccatccaagtctttttaggagtccccttctccagacctcctctaggtatcctcaggtttgcacctccagaacccccggagccctggaaaggaatcagagatgctaccacctacccgcctgggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgagcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttataatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgaggcctttccatgggtaaggagaaggcacttagcctccagatgatgaaatactgggccaactttgcccgcacaggaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattagacctgaatttctccacctataaaa

SEQ ID NO: 1052 - DNA, 509 bp, Homo sapiens
gcaggcccatattcagccacctcatccaggccttatcaaagaagagtcttatatgagatcaaatggctgcctttccccacaagattatatttttcctggtatgctctactttgacacatgtggctttctcaggaattttcaataaacgtgacttcactaggtggcctaagccccgatgtaaaatgtatatcccactggaccctgattacaatgcagactgccccaatgtgacagcacctgtttgtgcctcaaatggccacactttccagaatgagtgtttcttttgtgttgaacagagggaatttcattatcgtataaaatttgaaaaatatggaaaatgtgattaatgggtaccagagtaactacacttgcttattctttttctacttaattcagaatagtatttcttttagagtgtgagaatgtaaattaaataacatccctatgctgtacttaaatgtcgaacaaaatgagagacaaaaatgaaggaatcaaactgacaagaacca

SEQ ID NO: 1053 - DNA, 655 bp, Homo sapiens
tccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaaggggatgttccaccgggaattagaaataccatctgccatatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaattta

SEQ ID NO: 1054 - DNA, 1183 bp, Homo sapiens
ctacctgctccaccctcaacccaccagaaccatgggctgctgtggctgctctggaggctgtggctccggctgtgggggctgcggctctggctgtgggggatgtggctctagctgctgtgtgcccatctgctgctgcaagcccgtgtgctgctgtgtgccagcctgttcctgctccagctgtggctcctgtgggggctccaaggggggccgtggctcctgtgggggctccaagggggactgtggctcctgtgggggctccaagggaggctgtggttcttgtggctgctcccagtgcagctgctataagccctgctgttgctcctcaggctgtgggtcatcctgctgccagtccagctgctgcaaaccctgctgttcccagtccagctgttgtaagccctgcagctgctcttcaggctgtgggtcatcctgctgccagtccagctgctgcaagccctgctgttcccagtccagctgctgtaagccctgctgctgctcttcaggctgtgggtcatcctgctgccagtccagctgctgcaagccctgctgttcccagtccagctgctgtgtcccaatttgctgccagtgcaagatctgaggctctgcctacaaatctcagctggtcccacagatctgggctctccaggaatgactgtagctgtgtcctgaattcctgaagcacatctctgagtctgtcctcctctggactaaggcagcctagcgtccagggctcagtactcagctgctcagcctctgaggtcatgagggcttctggcatgctgggtgctgcccatcaaccctcccagaatcccctcttcctttcctgacctcatcacttcaaccttctcagggcttcaagatcccacatccctgggcccctcctgtgagcctgctggaaacacactgaaactggaatcctccgacctgctgccgcctctccccggtccctgcaacctcctggctcctccacccttcatcttcatcctgcctgagctgccacagctccgattgtttttggagttgacctagaggactcagaattattagagaccccaggatcctctcctgaggaggaggggcgcccagtctcctcttctacctctgacctggccttgtttctttccccagggcttcgccttgtaagtgcctaggctgaatcttctaaataaatacgatccacacctcc

SEQ ID NO: 1055 - DNA, 864 bp, Homo sapiens
gggctccgctggctgcggtcgcctgggagctgccgccagggccaggaggggagcggcacctggaagatgcgcccattggctggtgctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaa

SEQ ID NO: 1056 - DNA, 249 bp, Homo sapiens
atgaagatactttgtatttttctgacctttgtcttcactgtgtcttgtggtccatcagttccacagaaaaaaacaagagaagttgcagagagaaaaagagaatgtcagcttgttcgtggtgcttgcaagccggaatgcaacagctgggaatatgtatattattactgcaatgttaacccctgctgtgcggtatgggaataccaaaagccaatcattaacaaaatcactagtaaactccatcaaaaataa

SEQ ID NO: 1057 - DNA, 186 bp, Homo sapiens
atgaagattcacgtctttctctttgttttatttttctttctggtccccattgccaccagggtgaaatgtgccgtgaaagacacctatagttgctttatcatgagaggcaaatgtcgacatgagtgtcatgattttgaaaaaccaattggtttctgcacaaaactaaatgccaactgttatatgtag

SEQ ID NO: 1058 - DNA, 1498 bp, Homo sapiens
gggcgatggggaacctgtttatgctctgggcagctctgggcatatgctgtgctgcattcagtgcctctgcctggtcagtgaacaatttcctgataacaggtcccaaggcctatctgacctacacgactagtgtggccttgggtgcccagagtggcatcgaggagtgcaagttccagtttgcttgggaacgctggaactgccctgaaaatgctcttcagctctccacccacaacaggctgagaagtgctaccagagagacttccttcatacatgctatcagctctgctggagtcatgtacatcatcaccaagaactgtagcatgggtgacttcgaaaactgtggctgtgatgggtcaaacaatggaaaaacaggaggccatggctggatctggggaggctgcagcgacaatgtggaatttggggaaaggatctccaaactctttgtggacagtttggagaaggggaaggatgccagagccctgatgaatcttcacaacaacagggccggcagactggcagtgagagccaccatgaaaaggacatgcaaatgtcatggcatctctgggagctgcagcatacagacatgctggctgcagctggctgaattccgggagatgggagactacctaaaggccaagtatgaccaggcgctgaaaattgaaatggataagcggcagctgagagctgggaacagcgccgagggccactgggtgcccgctgaggccttccttcctagcgcagaggcggaactgatctttttagaggaatcaccagattactgtacctgcaattccagcctgggcatctatggcacagagggtcgtgagtgcctacagaacagccacaacacatccaggtgggagcgacgtagctgtgggcgcctgtgcactgagtgtgggctgcaggtggaagagaggaaaactgaggtcataagcagctgtaactgcaaattccagtggtgctgtacggtcaagtgtgaccagtgtaggcatgtggtgagcaagtattactgcgcacgctccccaggcagtgcccagtccctgggtaagggcagtgcctgataataccccacacaagttcacttgattaattgcatcagtggaaggggacatagcttctctcttagagagaacagattggaaagcaatcggaaaattgcagttttggtctgtagtcctcatgatatctgctatcagtggggaaaatggaggcccaagattctacagcatattcctggcggggctgaaattggaacctgggcctcctgactttggcagacccccatttcatctttcctgcaaactactttcccatctttgtgcctgtacttatgcagctttctacagggagagtttggtttggggtctatatctagagggaccttcaaagtatttgttcctttaaatttcagaccatgtccaacccagctgtgctgctgggaatcaggagaatagaagcaaaaaacgaaagagttctgttcagacttctgaagagcagc

SEQ ID NO: 1059 - DNA, 1513 bp, Homo sapiens
cacggtgcctgcacgggacgccgctcgatccccgagccccctcgccgtccccgacagcccccccggcgccatgcaatcccggcttctactcctcggggcacccggaggccacggcggcccggcctcgcggcgcatgcggctgctcctgcggcaggtggtgcagcgcaggccgggtggcgacaggcagcggccggaggtcagactgttgcacgccggctcgggggccgacacaggtgatacagttaatattggagatgtatcctacaagttgaaaattcctaagaatccagaacttgtgccacagaactacatttcagactctctggctcaatctgtagttcagcatctaagatggataatgcagaaggatcttttggggcaagatgtttttctaataggacctcctgggcctcttcgacgctctattgctatgcagtacttggagctgaccaaacgggaggtcgaatacattgccctgtcaagggacaccactgaaactgatctcaaacagcgacgagagatccgtgcaggcacagccttttacattgatcagtgtgcagttcgtgcagccacagaaggcagaactctcattttggaaggtttggaaaaggcagagaggaatgttttgcctgttttgaacaacttgctggaaaacagagagatgcagcttgaagatggacgcttcctgatgtctgctgagcgttacgacaaacttctccgagatcataccaaaaaagagttggattcttggaaaattgtccgagttagtgaaaatttccgagtgattgccttgggcttgccagtgccaaggtattctgggaatccattagacccccctcttcgttctcgatttcaagccagggatatttattatttacccttcaaggaccaacttaagttgttatattcaattggagccaatgtttctgctgagaaagtttctcagctcttgtcctttgccacaactctgtgttcccaagaatcttctactcttggacttccagactttcctttagatagtttagcagctgcggttcaaatcttggattcctttcctatgatgccaatcaaacatgcaatccagtggctttatccatatagtattttactaggtcatgaagggaagatggctgtggaaggtgttttaaagcgctttgaacttcaagattcaggaagctctctacttcctaaagagattgtaaaagtagagaagatgatggaaaaccatgtgtcccaagcttctgtgaccatccggattgcagataaagaggtgaccattaaggtgccagccgggaccaggctattaagtcaaccttgtgcgtcagaccgtttcatacagactttgagccataagcagctacaggctgaaatgatgcagtctcacatggttaaagatatatgtttaattggaggaaagggttgtggaaaaacagtgatcgctaagaactttgccgataccttaggatacaacatagaacctattatgctctatcagcataaagtacctcatata

SEQ ID NO: 1060 - DNA, 2144 bp, Homo sapiens
aggcggggtcacgcggaaggccgggcagcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgggtgtgttgagtaaatcaattaattggagggagctggaaaagcaatattatacccagacagtttatgaagaagaaattattcacatgcttgaatactgtggaacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgttactgtttatgaaaaactaaatttttaatcatgaataatttattaaattaaataaatttattcatagaaacttttctgggttttagtaaaattgctaaatcaaaccaagattttaatatatcagcatttactttgtacccttataacatttcactcttgacttgatttgagaaacatgtttattttttgaatgttcttgtgttcaactaattttctgctgtggaaataaatacttatgatatat

SEQ ID NO: 1061 - DNA, 2177 bp, Homo sapiens
agcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataagattgaagagcaatcagattgtaagatcttagatggacactttgtttcccccatggctcactatgtgcctgatatcatgccaattgaatctgttattgcaaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcaggtaagacggctggtctaaacatgtattcgttcatttgttgtttgttttctggattttttgcttcaacaaatgtaaaagatcacatatttttatagtctgtttcaatctttgaattccctcctcacctcccacaaatctcacagagttacttttccctctttcctagaatttgatcttcttattttcttctagagaactaagcatgatgcatattataggcatgctttatcgtgtggctttcccctcttcaaatattaatggccaggtattttaggatgtgagaaggaagatcatggcttgttaaagttgctttggtgcatcaagagttttttcactctattctgatgttttttcagaatggcctgaacatctgtggaataatttagcaatgtttttcagttagcaagtgaatattgaaccttaaataagaagtgcttttaatgtgaacaaccttatatgactccactattttagttagaacttataaaaacttttatgctggctgggcgcggtggcttacgcctgtaatcccagcactttgggaggcggaggcgggtgtatcacgaggtcaggagatcaaggccatcctggctaacacggtgaaaccccgtctctagt

SEQ ID NO: 1062 - DNA, 1040 bp, Homo sapiens
aactccaataaaaatccagacagaggtatttaagaagaaaggcttttctatcaaagttctttctcttcttggacttttaaattgtggctacctaaattgagtatctggcaagagtaagattaagcagtaatttgttccaaagaagaatcttctaccaaggagcaactttaaagaatgaaattaactttcttcttgggcctgttggctcttatttcatgtttcacacccagtgagagtcaaagattctccagaagaccatatctacctggccagctgccaccacctccactctacaggccaagatgggttccaccaagtcccccacctccctatgactcaagacttaattcaccactttctcttccctttgtcccagggcgagttccaccatcttctttctctcgatttagccaagcagtcattctatctcaactctttccattggaatctattagacaacctcgactctttccgggttatccaaacctacatttcccactaagaccttactatgtaggacctattaggatattaaaacccccatttcctcctattcctttttttcttgctatttaccttcctatctctaaccctgagccccaaataaacatcaccaccgcagatacaacaatcaccacaaatccccccaccactgcaacagcaaccaccagcacttccacaaaacccacaatgacgatcagctcctcaacagtacctatctcttcaacaccagagcctgccacctccatatcagcagcaacccccgcagcatctactgaaaatactactcaaattctcgccaaccgtcctcacacagtattgctcaatgccactgtccaagttacgacttccaaccaaactatattaagcagcccagcctttaaaagtttttggcaaaaactctttgccatttttggttgaacatgcaataaatgatattttccaaactgctctgatatcttagaagaaataaactgcaatgattttgatggaaccaaccctgatctaaccagcacactaaataaagtatttgagcaata

SEQ ID NO: 1063 - DNA, 1082 bp, Homo sapiens
gcggccgcggaggaggtgcggccccaaggggaggaggtgcccgctcaccgcagaccgcccgcggcagaggccgccccggtcgcgccgcggcgggagcggccggtggaggctgcgcggccgagggggagggccgggggagcggacgtcgcctctgctggtctcccacctcccgccgccccccgcccgcaggctcccaagccttagtcggcgccgagcatcccgctgccccggaccctcccgcgggcgcgcaccaggctcaactcaggctcaggactgcaggtagacatctccactgcccaggaatcactgagcgtgcagacagcacagcctcctctgaaggccggccataccagagtcctgcctcggcatgggcctcaccattgaggcagctccactgtctgtgctggtctgagggtgctgcctgtcatgggggcagccatctcccagggggccctcatcgccatcgtctgcaacggtctcgtgggcttcttgctgctgctgctctgggtcatcctctgctgggcctgccattctcgctctgccgacgttgactctctctctgaatccagtcccaactccagccctggcccctgtcctgagaaggccccaccaccccagaagcccagccatgaaggcagctacctgctgcagccctgaaggcccctggcctagcctggagcccaggacctaagtccacctcacctagagcctggaattaggatcccagagttcagccagcctggggtccagaactcaagagtccgcctgcttggagctggacccagcggcccagagtctagccagcttggctccaataggagctcagtggccctaaggagatgggcctggggtgggggcttatgagttggtgctagagccagggccatctggactatgctccatcccaagggccaagggtcaggggccgggtccactctttccctaggctgagcacctctaggccctctaggctggggaagcaaactggaacccatggcaataataggagggtgtccaggctgggcccctcccctggtcctcccagtgtttgctggataataaatggaactatggctctaccc

SEQ ID NO: 1064 - DNA, 1603 bp, Homo sapiens
agtttctggagctgttccgagtcccgtggagtctccatctgagccctttcctagtccaggcatcccgatgttggtggatggcccatctgagcggccagccctgtgcttcttgctgttggctgtggcaatgtctttcttcggctcagctctatccatagatgaaacacgggcgcatctgttgttgaaagaaaagatgatgcggctgggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtga

SEQ ID NO: 1065 - DNA, 3986 bp, Homo sapiens
attcttcccgaatggcctcacgtgtgctccctatcatcacgccttttcagctaggcaacgctcagagtcacacctgagtggaggccgacgcccctttggaggcgactccagccataaaaagtcctgcttggagctggttttagccacagagggccaataaatggccccttctgaatgaggtgcccctgcacctctgcagagcctgctgccagcctccaggatctaactgggctctgattcaccgctcccaaccccacatccaggcatcccgatgttggtggatggcccatctgagcggccagccctgtgcttcttgctgttggctgtggcaatgtctttcttcggctcagctctatccatagatgaaacacgggcgcatctgttgttgaaagaaaagatgatgcggctgggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctgtctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcgcgagtagttggaattataggcatgtgccaccacacccagctgatttttgcatttttagtagagacaggttttcaccatgttggcgaggctggtatccaactcttgacctcaggtgatccactcgccccttggctcccaaagtgctggaattacaggcattagccaccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaagattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaatg

SEQ ID NO: 1066 - DNA, 240 bp, Homo sapiens
atgaaactccattcccttatttctgttctcctcctctttgtgactttaataccaaaaggaaagactggcgttattccaggacaaaaacagtgtattgctttgaaaggggtgtgcagagacaaactatgcagcacactagatgataccattggtatatgtaatgaaggaaaaaaatgttgtagaaggtggtggatacttgagccctatccaactccggttcccaaaggaaaatctccttag

SEQ ID NO: 1067 - DNA, 709 bp, Homo sapiens; identical to SEQ ID NO: 820

SEQ ID NO: 1068 - DNA, 996 bp, Homo sapiens
caggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtgacatccttcccaacgagacaccctgctacatcaccggctggggccgtctctataccaacgggccactcccagacaagctgcaggaggccctgctgccggtggtggactatgaacactgctccaggtggaactggtggggttcctccgtgaagaagaccatggtgtgtgctggaggggacatccgctccggctgcaatggtgactctggaggacccctcaactgccccacagaggatggtggctggcaggtccatggcgtgaccagctttgtttctgcctttggctgcaacacccgcaggaagcccacggtgttcactcgagtctccgccttcattgactggattgaggagaaactacagggcaacaaggcaccagagtcccggacttaggaccactgtgtgtgattcaccgtgaacactggcatattaaaggctctgagaagtcctgtaggaaaggacaatttgaactttgtttgagctcatattttccaatcccatctgacctttagttcttcactgagtgcccactgggttatattctgggagccgaggccacagcagtgaacaaagcacacaaaaccccccgccccatgggggctccgttctagtgggtccatttatcatcaaacatctattaatatctctagaatgtgcccatcaggacaccatccagatgctgctgcgcttttccaggccacacagaggggacaccctccaggtgcatcctgcatgaatatcaggctcaaccgtgctttcagggtaggaagcggagggcatttgaagagtcctttcccttccttcattcatttgttgtctccttgaataaatgctgttgaaaaccta

SEQ ID NO: 1069 - DNA, 1275 bp, Homo sapiens
ccagcttccagcctaccctgcatctcttccctctgaattgcaggaaccctcccagcctccatgccgcctttcctgatcaccctcttcctctttcactcttgctgcctccgagcaaatggccacctccgtgaaggaatgacattgctgaagactgagtttgcacttcacctctaccagagtgtggccgcgtgtagaaatgagacgaactttgtcatctctcctgctggtgtgtccctccccctggagatcctgcagtttggagcagaagggagcactggtcagcagctggcagatgccctggggtacactgtccatgacaaaagggtgaaagatttcttgcatgctgtttatgccacactacccacctccagccaaggcaccgagatggagctggcctgcagcctttttgtgcaagtgggaacgccactgtccccctgctttgtggagcacgtctcctggtgggctaacagcagcctggaaccagccgacctcagtgagcccaatagcaccgccatccagactagcgaaggggcctccagagagactgcaggtgggggccccagtgagggccctggtggctggccgtgggagcaagtcagtgcagcatttgctcagcttgtgcttgtgagcaccatgtccttccaaggcacttggcgaaagagattctcctccacagacacacagatcctgcctttcacctgtgcctatggcctcgtccttcaggtccccatgatgcaccaaacgaccgaggtcaactacggtcagttccaggacactgcaggccatcaggtgggggtgctggagcttccttacctgggaagtgcagtgagtctgttcctggtgctgccccgtgacaaagacacccccctgagccacatcgagccacacctcacagccagcaccatccacctctggaccaccagcctgaggagagccaggatggatgtgttcctgcccaggtttaggatccaaaatcaattcaacttaaaaagcattttaaattcttggggagtcaccgatctttttgatccactcaaagctaacttgaaaggaatttcaggccaagatggcttttatgtttctgaagcaatccacaaggccaagattgaagttttggaggaaggcaccaaggcatctggagccacagctctgttgttattgaaaaggtctcggattcctatttttaaagcagatcggccattcatctatttcctgagagaacctaacacagggtttgtcttcagtattgggagagtttcaaatcccctagactaa

SEQ ID NO: 1070 - DNA, 560 bp, Homo sapiens
cgttggaacgtccttgggcttctgaactagtgcccatgtgtgcctcggcctttcccaagggccagcttcttcctgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctga

SEQ ID NO: 1071 - DNA, 3832 bp, Homo sapiens
ggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1072 - DNA, 3678 bp, Homo sapiens
ctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1073 - DNA, 3968 bp, Homo sapiens
gaggaactgagaggagaaggagaagagagtgggcccgccttcagggtctggggccttccaggttgggtcgtaggggcgggagcgcacaggctgcgagagaggagcaaaggttggtggagggagaagagcagtctggggcctggctggacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1074 - DNA, 560 bp, Homo sapiens; identical to SEQ ID NO: 1070

SEQ ID NO: 1075 - DNA, 3832 bp, Homo sapiens; identical to SEQ ID NO: 826

SEQ ID NO: 1076 - DNA, 3678 bp, Homo sapiens
ctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1077 - DNA, 3845 bp, Homo sapiens
gatcccagaagtaggaggggcgtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1078 - DNA, 3968 bp, Homo sapiens
gaggaactgagaggagaaggagaagagagtgggcccgccttcagggtctggggccttccaggttgggtcgtaggggcgggagcgcacaggctgcgagagaggagcaaaggttggtggagggagaagagcagtctggggcctggctggacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1079 - DNA, 3971 bp, Homo sapiens
gacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1080 - DNA, 309 bp, Homo sapiens
atgtcagtcatgaagccctgtttaatgaccattgccatccttatgatcctggctcaaaagactccaggtggcctgttcagatcccacaatggcaagagccgagagccttggaatccatgtgagctttaccaaggcatgtgcagaaacgcctgcagagaatatgaaatccaatacttaacctgcccaaatgatcaaaagtgctgcctgaaactttctgtgaaaataaccagttctaaaaatgtgaaggaggattacgactctaactccaacttgtcagttacaaacagttcaagctactctcacatttga

SEQ ID NO: 1081 - DNA, 267 bp, Homo sapiens
atgctgccagatcatttctcacccctctcaggagacattaaactctctgtcctggccttagttgtccttgtggtcctggctcagactgccccagatggatggatcagaaggtgctattatggaactggcagatgcaggaaatcatgcaaagaaattgagaggaagaaagaaaaatgtggggaaaaacatatttgctgtgtccctaaagaaaaggataaactatcacacattcacgaccaaaaagagacaagtgagctatatatctag

SEQ ID NO: 1082 - DNA, 1936 bp, Homo sapiens
acctgcaggcccgggccgcggggttggtttccaccctggaggttgctgacaccctgtgccctcggctgacttccagccggtggcacagacgcctccagggggcagcactcaagcgcatcttaggaatgacagtaacagcgggaacatgaagccgccactcttggtgtttattgtgtgtctgctgtggttgaaagacagtcactgcgcacccacttggaaggacaaaactgctatcagtgaaaacctgaagagtttttctgaggtgggggagatagatgcagatgaagaggtgaagaaggctttgactggtattaagcaaatgaaaatcatgatggaaagaaaagagaaggaacacaccaatctaatgagcaccctgaagaaatgcagagaagaaaagcaggaggccctgaaacttctgaatgaagttcaagaacatctggaggaagaagaaaggctatgccgggagtctttggcagattcctggggtgaatgcaggtcttgcctggaaaataactgcatgagaatttatacaacctgccaacctagctggtcctctgtgaaaaataagattgaacggtttttcaggaagatatatcaatttctatttcctttccatgaagataatgaaaaagatctccccatcagtgaaaagctcattgaggaagatgcacaattgacccaaatggaggatgtgttcagccagttgactgtggatgtgaattctctctttaacaggagttttaacgtcttcagacagatgcagcaagagtttgaccagacttttcaatcacatttcatatcagatacagacctaactgagccttacttttttccagctttctctaaagagccgatgacaaaagcagatcttgagcaatgttgggacattcccaacttcttccagctgttttgtaatttcagtgtctctatttatgaaagtgtcagtgaaacaattactaagatgctgaaggcaatagaagatttaccaaaacaagacaaagctcctgaccacggaggcctgatttcaaagatgttacctgggcaggacagaggactgtgtggggaacttgaccagaatttgtcaagatgtttcaaatttcatgaaaaatgccaaaaatgtcaggctcacctatctgaagactgtcctgatgtacctgctctgcacacagaattagacgaggcgatcaggttggtcaatgtatccaatcagcagtatggccagattctccagatgacccggaagcacttggaggacaccgcctatctggtggagaagatgagagggcaatttggctgggtgtctgaactggcaaaccaggccccagaaacagagatcatctttaattcaatacaggtagttccaaggattcatgaaggaaatatttccaaacaagatgaaacaatgatgacagacttaagcattctgccttcctctaatttcacactcaagatccctcttgaagaaagtgctgagagttctaacttcattggctacgtagtggcaaaagctctacagcattttaaggaacattttaaaacctggtaagaagatctaatgcatcctatatccagtaagtagaattatctcttcatctgggacctggaaatcctgaaataaaaaaggataatgcaataaacacagttgcaggaaagtatgttagctatatactatgaagtactcttagtttacttatgttgaatggcttagctattaatactcaaattgagttaaaatgaaaattcctccttaaaaaatcaaacgtaatatgtattacatttcatggtacattagtagttctttgtatattgaataaatactaaatcacctaggtgtctatgttctatcacatctacaaacatgtcacttcctaattaacaaaatgttcttcctttagtttgcttttgcacttaaaatatatataattgacttttttgg

SEQ ID NO: 1083 - DNA, 441 bp, Homo sapiens
ccctggggaagagaagctgagaggaactcctcactcagctagcttcaggagccatgacatcatctctaccatggaaattccactcactctcctgtgcccccacatttgtcctaggcctcagagtccctataaagagagattcccaactcagtatcagcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaactaaatccagtgagtggaagttacagggagtctgcttccagtgctgctccgggaaggatcccatccaccagagctgccccacatggaccatggtcaggcagaggaagatgcctaccacaggcaagggataa

SEQ ID NO: 1084 - DNA, 458 bp, Homo sapiens
caacagaagccaagaaggaagccgtctatcttgtggcgatcatgtataagctggcctcctgctgtttgcttttcataggattcttaaatcctctcttatctcttcctctccttgactccagggaaatatcctttcaactctcagcacctcatgaagacgcgcgcttaactccggaggagctagaaagagcttcccttctacagatactgccagagatgctgggtgcagaaagaggggatattctcaggaaagcagactcaagtaccaacatttttaacccaagaggaaatttgagaaagtttcaggatttctctggacaagatcctaacattttactgagtcatcttttggccagaatctggaaaccatacaagaaacagagaagaaagctgaggcaagatttaagattgtggaagaaagagcctggcttacgaatttttaaaaactatgtgtacatc

SEQ ID NO: 1085 - DNA, 2161 bp, Homo sapiens
ggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctggactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatg

SEQ ID NO: 1086 - DNA, 4538 bp, Homo sapiens
atgcggcacggcgtcgcctgggcgctgctggtggccgcggccctggggcttggggcgcgcggggtgcgcggcgcggtggcccttgccgacttctacccgttcggcgccgagcgcggcgacgccgtcacccccaagcaggacgacggcggctcggggctgcggccgctctcggtgcccttcccgttcttcggtgccgagcactccggactctacgtgaacaacaacgggatcatctccttcctgaaggaggtttctcagttcaccccagtggccttccccattgccaaggaccgctgcgtggtggcagccttctgggcagatgtggacaaccggcgtgcaggcgacgtgtactaccgggaggccaccgacccagccatgctgcgccgagccacggaggacgtcaggcactacttccccgagctcctggacttcaatgccacctgggtttttgttgccacctggtaccgagtgaccttctttggaggcagttcctcatcccctgtcaacacattccagactgtgctcatcacagacggcaagctctccttcaccatcttcaactatgagtccatcgtgtggaccacaggcacacacgccagcagcgggggcaacgccactggcctcgggggcatcgcagcccaggctggcttcaacgcaggcgatgggcagcgttacttcagtatccccggctcgcgcacagcagacatggccgaggtggagaccaccaccaacgtgggtgtgcccgggcgctgggcgttcagaatcgatgatgcccaggtgcgcgtggggggctgcggccatacaacgtccgtgtgcctggccctgcgcccctgcctcaacggcggcaagtgcatcgacgactgcgtcacgggcaacccctcctacacctgctcctgcctctcgggcttcacggggcggaggtgccacctggacgtgaacgaatgtgcctcccagccctgtcagaatggtgggacctgtactcacggcatcaacagtttccgctgccagtgcccggctggctttgggggacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactgcagctgcccctaccgcttcactgggaggcactgtgagatcgggaagccagactcgtgtgcctctggcccctgtcacaacggcggcacctgcttccactacattggcaaatacaagtgtgactgtcccccaggcttctccgggcggcactgcgagatagccccctccccctgcttccggagcccgtgtgtgaatgggggcacctgcgaggaccgggacacggatttcttctgccactgccaagcagggtacatgggacgccggtgccaggcagaggtggactgcggccccccggaggaggtgaagcacgccacactgcgcttcaacggcacgcggctgggcgcggtggccctgtatgcatgtgaccgtggctacagcctgagcgcccccagccgcatccgggtctgccagccacacggtgtctggagtgagcctccccagtgccttgaaatcgatgagtgccggtctcagccgtgcctgcatgggggctcttgtcaggaccgcgttgctgggtacctgtgcctctgcagcacaggctatgagggcgcccactgtgagctggagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttagggccctgctgcctgggaagaggtacaccatccagctgaccaccctcagtgggctcaggggagaggagcaccccacagagagcctggccaccgcgccgacgcacgtgtggacccggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacaacccacagcctcggcgcagctcgagaacatggaggaagcccccaagcgggtcagcctggccctccagctccctgaacacggcagcaaggacatcggaagtgagtcagcagcgctggtggggactttgggactgactgactgctctcaggggccttagaggctgcaggcaggagggaccacccacggtgaggaatcaggaggcacagagcctacctgaggggaggctgagcaccaggcaccccggtgtgggaagatggggtgaagctacaccacccaagcagtgggaccccacagacgggaacaggccagggggcaggacccacccaaaccacccagagtctgagctagagagactggctttgatgctgcctcccctcccctctcctccttcgcctccacatgcagcagagcccaccccagcccctgcctctgggcccctcacccctcacttctccaaagaggagcaggcggagtcaggatgggagaagcagagggagcagccactgggcgagccccagcttgaggactagctgggccctgtggacactcaggttatgcaggacctgaactgtctcctagtccggggctctgcctcgtgaggatcgaggccagcacgtccctgcagggcaccaagcatctgctgagcacctgcagtaagagttcccagacgctcacgaggcagttccccttcgggcagcaccaatacatgtgtgttcctca

SEQ ID NO: 1087 - DNA, 3274 bp, Homo sapiens
agctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccaagcaagcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgttggatttgttttcttttccgttttatatgtacaacaagggctttcttctcaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggtatggaaacccatttcgagccttttattttaccactcacaaacgctccacagaaaggtcagtcgtatagagtagacagatttatgaatggtgatttttaaaatcggagacctagttcagtgcaagtgattatgagaggtgagcaccgagcctgcaccaattcactcagagctcaaagcatgtgggtgcaccccgtcagtcccctagtggtgcttcatttccagggcatctgagagctggactctggtttttatcctttctgtatttacacattataagaacaataaatcatgtaatgttggttacattacaaatgcatgttcattttctctacagatttatgtatcgataatgacccaaattaagaggctttcacttaatcaaaatgtaaatgagagagacatgccatatcatgcattttcagcgacccatagctctaagcaggactattctccaagggcttttgattttgaaggagaaacctcagctgcctgtgatgatgataatggaaggatggaggggggattgaagactgtaagtggtgcagagataaggcaactcctctgtgaatttgccttccaggccaatttagaagcttagtcacaggattctgaaggcagctgtgcaagttaaagctgttctgaatggcattaatgtatgcagtcattcagccaatggaaatgcgtggaagttttaaccttgatgtgggataaaggcttcgtggaatgagcagtaccctgcacaaccccgcggccgtcccgatttcctcaaacacgtgacatgggatgaagggagcacaaacatactgactttatccttctttaggtttttccctaaagaagtattgatgctaccatcagtaatggaaaattacattgctaatatttaaggtctcttcagccattaaattaaaaagtctgattacttcaccaggatgatttctgagatctcatctcatatcgtcctgaatacacacacacacacacacacacgcacacacacacacatctcagaaatcatcctaatcaaatatagactttatatatatcaaatatatatatacatgtagaaatacatataggtatgtatctttaagtccttgcttgtgaacaatgcttttaaatgtttttaaaatactgtatgccaaaataggttttctcttaatgctttacttcctaatggatgtgatttgcagatttgtagggcacttggattagggttctctgagtttgccctgccttataatgtagatgagcaactctcctggcatgccttggtcattgcaatttatgtcagtctgatgaacagatggcttagcctctctgaagcccaatgtgtgtggatttgtctaatttttttctttataatcttttctgcttaccaaattaaaggacaaactagtatagctggaacatatatgtgtgtatccatacacactaaacacacaggtatatgctaaattgtaatggtaaccaaatgatggttacaactttgtgactattatttgaggaagatttaatgtctttggagtgattttcccctctttcttcacattatcataaaagaagttagacactacaggcaagattacagagtagcctaagcagacaatttacaacctaattagcaagaactccaaatcatggaagtgaaattattattatcctacatagactgttccaagttagatgtcatcaatctgttcggcagaataaaatcaaacagattacctattccaagtgaagaattccaagggtagaatgaaatgctttatctatttctagaatgttttcttagcttttggggtttaataatgcaatctcaaaatatctatttattttattttaatatctcttagcgctgtgattagtgctaaatgataaactctagatctcttctaacaattatcaaataaaaattactgctctttttgcatcccattgccagccttgctgtcagattcaaaattgctttttctagagttaaaggtagaaggagagaaaaaagtgactcatgaagtctatattcattaaaagtcctgttcactaaacatatctgcttatatcaaagagtaacttgaaatatctgaaaatatttaatttcaatatttccaaccagtgaatactggataatatttttatatacttctatcaacattttctaatttcgatttcagaagctggggcagtccagtcactcactttacttatgtgtaagttcctatacttgcacaattattatatatgattcagtatctggggtggatatttatatattatattcactgtaatacccacatcctgatttatgatttttgcctcacgattttcagattatattcaaataaagcttatttc

SEQ ID NO: 1088 - DNA, 1371 bp, Homo sapiens
agctccggccccgaccggaagccccaccgcaccgtcagggacgcggactcgggagtgcgcacattcgcagcccgggcagccctgctgcgcaccgggcctcgcgccccgcgccccgcgccccgcgccccgcgccccgcaccggcctccaggatcatgtggtatgtcagcaccaggggcgtagccccacgggtcaactttgagggggccctcttctctggctatgcacctgacgggggcctctttatgcctgaagagctcccacagttggacagagggaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagtgggagagacaggactacgaaaaaatggctgtaatggagtgtgatgggtgctgtgtggaactgtgccttggaaactgtgggcccagaagagggagcgtgacagatatcccagggacagccatggtcagaggtggtggctga

SEQ ID NO: 1089 - DNA, 1003 bp, Homo sapiens
agtgtgagaagcagtatgtgtgagcatgtgtgtgtgtgtatgtgtgtgggggggggtgtaaaatgtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcagatctctggtccactgccacctacacaagcagccaaaacaggcccagagctgatccagttcagagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggct

SEQ ID NO: 1090 - DNA, 1508 bp, Homo sapiens
gggcccgggcgcggcggcggcggcggcggaggatggcgcgcgcggggcccgcacgtggaggccggcgcgggggcgcgggcagggccggctgctgagacgcgctgctgccccccgcgcgggcgccgcggcttcaatggcgccatcgcccaggaccggcagccggcaagatgcgaccgccctgcccagcatgtcctcaactttctgggcgttcatgatcctggccagcctgctcatcgcctactgcagtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacgcaagaatcatcaagaccaagcagtggtgtgacatgcttccgtgtctggagggggaaggctgcgacttgttaatcaaccggtcaggctggacgtgcacgcagcccggcgggaggataaagaccaccacggtctcctgacaaacacagcccctgaggggccccgggagtggccttggctccctggagagcccacgtctcagccacagttctccactcgcctcggacttcacccgttctctgccgcccgcccactccgtttccctgtggtccgtgaaggacggcctcaggccttggcatcctgagcttcggtctgtccagccgacccgaggaggccggactcagacacataggcggggggcggcacctggcatcagcaatacgcagtctgtgggagcccggccgcgcccagcccccgccgaccgtggcgttggccctgctgtcctcagaggaggaggaggaggaggcagctccggcagccacagaaggctgcagcccagcccgcctgagacacgacgcctgccccaggggactgtcaggcacagaagcggcctcctcccgtgccccagactgtccgaattgcttttattttcttatactttcagtatactccatagaccaaagagcaaaatctatctgaacctggacgcaccctcactgtcagggtccctggggtcgcttgtgcgggcgggagggcaatggtggcagagacatgctggtggccccggcggagcggagagggcggccgtggtggaggcctccaccccaggagcaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaa

SEQ ID NO: 1091 - DNA, 1902 bp, Homo sapiens
cgcgcagcccctccggccgcgggcgcagcgggggcgctggtggagctgcgaagggccaggtccggcgggcggggcggcggctggcactggctccggactctgcccggccagggcggcggctccagccgggagggcgacgtggagcggccacgtggagcggcccgggggaggctggcggcgggaggcgaggcgcgggcggcgcagcagccaggagcgcccacggagctggacccccagagccgcgcggcgccgcagcagttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccggtgatcttgatagtggacaaagtgctcgagacccaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgcctggtcccagtaggtatcaggtctttctgtgcagctcagggagaccctaagttaaggggcagattaccaataaagaactgaatgaattcatccccccggccacctctctacccgtccagcctgcccagaccctctcagaggaacggggttggggaccgaaaggacagggatgccgcctgcccagtgtttctgggcctcacggtgctccggcagcagagcgcatggtgctagccatggccggctgcagaggacccagtgaggaaagctcagtctatccctgggccccaaaccctcaccggttccccctcacctggtgttcagacaccccatgctctcctgcagctcagggcaggtgaccccatccccagtaatattaatcatcactagaactttttgagagccttgtacacatcaggcatcatgctgggcattttatatatgattttatcctcacaataattctgtagccaagcagaattggttccatttgacagatgaagaaattgaggcagattgcgttaagtgctgtaccctaaggtgatatgcagctaattaaatggcagattttaa

SEQ ID NO: 1092 - DNA, 1575 bp, Homo sapiens
ctcacacgggcgcgcgcagcccctccggccgcgggcgcagcgggggcgctggtggagctgcgaagggccaggtccggcgggcggggcggcggctggcactggctccggactctgcccggccagggcggcggctccagccgggagggcgacgtggagcggccacgtggagcggcccgggggaggctggcggcgggaggcgaggcgcgggcggcgcagcagccaggagcgcccacggagctggacccccagagccgcgcggcgccgcagcagttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccgggcaacctggacgccaggctggatggaggggagaaggcgatgcagccgcaatggtagtctccatggtgtgtgaggagccggcacctgctctcacacgatgccatcaaagccctgcaggccacacttcttgccggccacctggcacccgaatctcagtgcttcctgcacgctcctccctggaggaggggcaagtagctaggtcagccaggtgtttggggcagggacaggtcccagtccttttcccctcctgctgccatactcaccctgggagaggctgaagatgacggaggcattgaaggtgtctccagctcccagtgtatccaccacgcggggtggcgggaaagcatccgagtggagcaatttgccatcagggcccagggcgtcggcgccctcctcagcccaggcacagacaagcacagccctgcaagacggctccactcagctgggtgttagcccaccccgtccccccagccatcctcccagctccagggcggactcctggagtccaggctcatcctgtaccttctaaagccccttcctggcttccccggctcaccctttcctcacacgaccatacaagcccctcaaggcttcctctgctgactggaaccccaagtgcttggccacatctttgctgacaaacacctgtgggcagtggaagagaagctggtggtcacttctaactcgtcattcaccaacagcagcctagcgttgcccccattacaacacgactcccccaacatgtccacatagatccccaacgtagcatctcactgtcccacgggaacgtggttttcttttttctttattttttgtgaagatggtctccctgaggctggtcttgaactcctggccccatatgatcttcctgcctcagcctcccaaaatttctgggattacaggtgtgagtcactgcacctggccagaagcatatttttatcgatgcttatat

SEQ ID NO: 1093 - DNA, 4975 bp, Homo sapiens
ggctatcctactgcagctggctgcatcagatgtgccaggcctgccctctagctcccaacaccatctgcctgatctaagctttgccatgttgttgtcactgctgggtgcctgtgctgtggtggggccattccatggccctgagtgggagccagtgcagggcctgctctcccagaatcacagctgcagggaccctcagtgctgtggcaacctgcttgtcctctgcctctttctggtctggcaggtccggcactgttggcaccaggtcaccaggacccgcttcagcacaaggaatgtcatcaaggtgccactgcagaagcgggcagtgccctccatgaggtgcgaaactgtcttcaagctgactcctgaattcttcagtcctggaaagtccaggggcctagattctcaacaatgcgcacaaaggcagagatggggataccggaggagcctccaggaatcatgggcccagaacctgctctctccacagcacccatgtccaggcccaccttcgggtgtccacacccactctgagcccatcttttgtaccacctccatttcaaacacctgtttactgcctcagaacagttcctggaaagcatggcaggtgccttggtgtctccatgatggtcagactcgccctgccttggacatgtgtcaagagatggagcagctgctgcttcactcacaggaaaggttggtgtcactggagcctgtcatcagtgtgaggtctcgccccacctccatgaccttaaccacctctcttccaaacttactttcagctgagaggctgcagttctgcccccagagagctcctgcctgatccttcccaccaaacactgagaatgtgcacttggaagtcttggcactgtcgaccagaggcctgggaaccagggggtaaaaaccagaaagcaggcagagaggatagtagagagacccaggctccaaggtgggtgaaccagacagggagcagacgggaggatgcttcagaaatccaggcatctggggagtagttcccagtagactttggaatggagggtgatgcagagactaacgtgttggagtgtgcaaaccagagactagtaataagtgaaactgatggcgagatcttgacaccagggtgggacacccaggaccggatgggagttgagagtagaaccaacattcaggaactagggaatagaaaccagagggaggctggaggtgagaatctccctgaaacccaggcacatatgggagagaaccaagaacagttaagatgtaaaattgatgcagagacccaaacacctgagtgggagaaccaggataagaatggaagtgaggatgctgtggagacccagacatttgagaagaaggacaagaaagaggctggagaggaggatggggaagagatccaggctcaaggattggggaagcaaggccagactggagatgagaatggtgaggagacccagacaccacagtgggagaaacaagatcagatgaaaggtgatgcggatgtggaaattcagatggaagaggggagaaacaaggatcaggttggaggtcaggatgctgcacaaacccaatcatgtgggagggagaacgtgggagaagtaaaaaaagagaatagtgtagagacccaggccttggattggggaaaacaggaatgtgttggaaatgggaatgttacagagatccagacaccaaggtgggagaagcatgatcaaggtggaagtaagaaagctaagaagacccaagcatctgggggagagaaccagaaacaattaagtcatgaaattcaagtggggtggggaaataagggcctgagaagagatgaagatgctaaggaaacccagatagctaccaagaagaagctcagggagataagagaaggattgggtggtgatccaggcactatggtggggaaaccggagacaagtagcaagtgaaatttatagagaatttgagatactatgttgggagaatcagaactggattggaggtgaacatagagcagaaattcaggcatcagagaagagagaccaaagaaaggatggatgtgaggatggcacaaatatcctggcacccgaggctgagatccaggaacaattaaaaggtgaaactgatgtggagactcagagcaatgagccacttagagaagaggatggtacagacattcagtcactagggaggagagaggttaaaggtgaggatgataaagacacccaggaacttgggaggaaaaatcagggtcagttaggaaatgaatttagtggaaagattcacataccaaaggggaagaatcaggaacatattagaggcgaagatggtgcacatacccagatatctgagtcagggaactggggcaaattaacaagtcaaattgatggagaaatgcattcagcagaatggaagaaagatcagcagattggaggtgagaatggggcagaaattcagatacaagggaagagaaacctgagagaagttggaggtgaggacggtgtaaagacctgggcacctgggaaagaaacccagagtcagtttagaagtgatcttggtagaaagatccttttatcagagtggaagagccagaagcagatgggaagtgagaatggaacagaaattcaggctccagtggagagaaaccagagagaacctggaggtgaggacggtgtaaagactcagagacctaagagagagaacgaggaccagttagatagtgaaattggagggagccattcaccagggaggaggaactgggagctgattggaaaggatgttgcagaaaatcaggcatcagagaagagaaaccagagagaggttggaaacgaggacggtagaatgatctggaggcttaggggaaaaaactggaggcttagagcgaagaaacagactgttaaaaagtaaagataatggaaagacccgtttatcagagtggaagaaccaggaacagggtggaggtgggaatgatgaagaaattcaaatacaggggaagagaaacctgagagggaccacagctgatgatggtacagagacccaggctcctgcaggagatgaccagggacagttaagagttgaaattgctgaagagatccaggtacaagggcaaggaaataagaatgacggtggagttgaggatgttgcagaactccaggatataggaagccagagaaagtgcacagatgaggatgttggagagcctcgagcaccaaggggaggaaacaaggatctggtcagaggagaggatgctgtgagggacagtctccaagtcgactgttctgggagtgagaggcccacaggcaggaagcacagcctaccatggcctccagccttcactggctatggatgtgggacccgggaacaggaacaggcagtggctgtgaatggtttcatctctgccccctgtcctgagatgaatcctgtcccccactggggtgaagtcttcctgctggtgggtggggagggagagcatctggccagccagggcacaacccctgccagggatcatagagtggggatcagtccagcctcccagcaggcccaacctgaatcctggagaagacgacaaagggacaaaggggtggatccagagaaggcccccagcctgactcggcagtcccaaaaccctccgtctctgacagctcccttgggcatgccctctgcctgctcctgtctcccgtgtggcccagccccggaagctgccatcattctagcgggtcctcccaccgccctcactgtcctgcccaaggggacaggcctcaagaagagcaaacgactgctcctggagtccctcatgcggaggaggattgcacacctgaagtggggtcttccccggcggatcctggagtcctatttcctgtttaacttcttaggatcttgctcattgacccttgctggggcgaggctctctggactgaacacaggccaggagctccaagcccagcaggaaaggtattgtgaggcccaaggctccccaccaggccttaagtccccagagaggttccagagggttcagcgcccagacagaaaaagctcgaaacttcctatacaagccagagctctggagaggaacagaccgcacatgtcagagcccattaagcatttccatccagcctgaaaaggccaggagagtcaggccaccagggggcgccagagaaccacaggagatccaggaagcgcttgctaggaccaagctcccagctcccaggacccccaggccggcagcggagtccaggagctggtgtggcccacaaagggtcggagagcctcccagtgagaacagtaggggcaggaaaatgatcaggtcaagggtctcccagctggcagagagggctcccagcagagtgaggacttcattctctagggcagaccacgcccactggaggaaggaatgtacatcctgggaggcctctaagctccccagactcaaatgccagcagctcacatactggagaagaggaagcctggaatctacagggtgcagaggggctgggcagcagccttcctgccattctgcagaacctgtcagcttcaaagggaggctccactctgcggtggcaaagctgggcctgacccttctggccaagatgtcctggtccccacagctcgccaagcgcaagcacttggcccctaacctgagcctgagggaacctgattctactctgcctcccaaagtgggtgatcctcgtgcaggggaggacagcatcggagatcacactgcttcacagagggatcttcagctgcaaggtcactgctgtactggggccacccttcctaagacagagagtccccagggccaggaggcacctgggaacccaaatggggctccacagaatacacgagcctccaaaaagtttagtattatgaagcatctgaatttttttctcttccagaatggctttaaaaagtagactcaggcccagagtcctcaggacatatcagaaaagctttgagagtgtcctgatccctgcaaagcctctaataaattggtcatttgggc

SEQ ID NO: 1094 - DNA, 2922 bp, Homo sapiens
gctcaggaacccaaacctgtcgggcaggttttgagagctgtggagagagggacagaggctggagaaggatgtatggcctgccctgggcttgtctgttccctcctgagcctgagccccttaccttcctgaccccatgaagcacacactggctctgctggctcccctgctgggcctgggcctggggctggccctgagtcagctggctgcaggggccacagactgcaagttccttggcccggcagagcacctgacattcaccccagcagccagggcccggtggctggcccctcgagttcgtgcgccaggactcctggactccctctatggcaccgtgcgccgcttcctctcggtggtgcagctcaatcctttcccttcagagttggtaaaggccctactgaatgagctggcctccgtgaaggtgaatgaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtcttcctgctgctgaccaccctcttgctgctgattggtgtggtctgtgcctttgtcaccaaccagcgcacgcatgaacagatgggccccagcatcgaggccatgcctgagaccctgctcagcctctggggcctggtctctgatgtcccccaagagctgcaggccgtggcacagcaattctccctgccccaggagcaagtctcagaggagctggatggtgttggtgtgagcattgggagcgcgatccacactcagctcaggagctccgtgtaccccttgctggcggccgtgggcagtttgggccaggtcctgcaggtctccgtgcaccacctgcaaaccttgaatgctacagtggtagagctgcaggccgggcagcaggacctggagccagccatccgggaacaccgggaccgcctccttgagctgctgcaggaggccaggtgccagggagattgtgcaggggccctgagctgggcccgcaccctggagctgggtgctgacttcagccaggtgccctctgtggaccatgtcctgcaccagctaaaaggtgtccccgaggccaacttctccagcatggtccaggaggagaacagcaccttcaacgcccttccagccctggctgccatgcagacatccagcgtggtgcaagagctgaagaaggcagtggcccagcagccggaaggggtgaggacactggctgaagggttcccgggcttggaggcagcttcccgctgggcccaggcactgcaggaggtggaggagagcagccgcccctacctgcaggaggtgcagagatacgagacctacaggtggatcgtgggctgcgtgctgtgctccgtggtcctattcgtggtgctctgcaacctgctgggcctcaatctgggcatctggggcctgtctgccagggacgaccccagccacccagaagccaagggcgaggctggagcccgcttcctcatggcaggtgtgggcctcagcttcctctttgctgcacccctcatcctcctggtgttcgccaccttcctggtgggtggcaacgtgcagacgctggtgtgccagagctgggagaacggcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccagtataccaacaagctacggcaggagttgcagagcctgaaagtagacacacagagcctggacctgctgagctcagccgcccgccgggacctggaggccctgcagagcagtgggcttcagcgcatccactaccccgacttcctcgttcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtggagacggggttttgccatgttgcccaggctggaagtgtctatgtttaactgcatcttataaaccagcaacaagttttctactgggaattagaatggtgcatacacaatgtattattatcactgtcagatgagcatgcttgaatgtagcatgactgcctctttttgcttttcctagaggttttttttttgcttgttactcatctgttgacctacctgggggaagtagcacccttgcatttcaaaaataaaattgatggcattacaaatggaataga

SEQ ID NO: 1095 - DNA, 1745 bp, Homo sapiens
acacactggggctcctctgcccgtgtcctgcctggggactcaggaatcgggatctccctccctgctgggccctcttgaactcacagctccaggaaactgggagactcatccctggtgttccagggagtctctgctgcccaccatctctgccccccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgcccctttcccccgatccaaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacagggtgaggggcgtgtgggcagagggggtttgggacagcagggtttgtgctaggggctctggagcctgccttgggttcttacaacctctctaaaaagccaggactgctctcatcatttcaatagggagaaaactgagactcagaaagagaaaggacttgccctgggtcgaattgaaggttgggagcctctgaaggcttttttaggaactgttccttccttacattgggataaaataactccaatatgaagagagcctcaagagtttctcaacctctccccacctcagcacctgtcccagctctgcctgacccaccgagtgacctgggaggtcgctcccctggcctcagtttccctatccgatttagggaatatagatgttaggatcactgacttc

SEQ ID NO: 1096 - DNA, 405 bp, Homo sapiens
atggccgcagccctggcgctcgtggcgggggtcctgtcgggggcggtgctgcccctctggagcgcgcttccgcaatataaaaagaaaatcacagacaggtgcttccaccactctgagtgctacagtggctgctgcctcatggacttggactccggtggagccttctgtgcccccagggccagaataaccatgatctgcttgccccagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtc

SEQ ID NO: 1097 - DNA, 1242 bp, Homo sapiens
ggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcagga

SEQ ID NO: 1098 - DNA, 1373 bp, Homo sapiens
cgcgggagcgcggcccctccgaggtccgcccgcggccggggagctgcctggcacccgcggcttccaaaggggaaagaaagttgcgcccgcgccaggcgcagcgcgctcggcggacgcggcctttcgggcgaaagttaggaggggccgggctggcgggcgggcgggttccgggggctcctttccgcaccagcggcggtcgctccccgtgggcgggacctcgggcgtgatcgtcgaggagaccgcggctccctcacctgccggcttgttcctcggggtccgcggagcgagcccagctctcggcgcgtgtcggagtctcccagccccgcggccccgagcgcacgatgcgcggacccgggcaccccctcctcctggggctgctgctggtgctgggggcggcggggcgcggccgggggggcgcggagccccgggagccggcggacggacaggcgctgctgcggctggtggtggaactcgtccaggagctgcggaagcaccactcggcggagcacaagggcctgcagctcctcgggcgggactgcgccctgggccgcgcggaggcggcggggctggggccttcgccggagcagcgagtggaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagcagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttatttaaaaaaaaaacacaaaaggaatgctccacatttgacgtgtagtgctataaaacacagaatatttcattgtcttcattaggtgaaatcgcaaaaaatatttctttagaaacataagcagaatcttaaagtatattttcatataacataatttgatattctgtattactttcactgttaaattctcagagtattatttggaacggcatgaaaaattaaaatttcggtcatgttttagagacagtggagtgtaaatctgtggctaattctgttggtcgtttgtattataaatgtaaaatagtattccagctattgtgcaatatgtaaatagtgtaaataaacacaagtaataaatgaa

SEQ ID NO: 1099 - DNA, 1656 bp, Homo sapiens
cgccgctgcgctggtaagcctgtgttttggttcgctatggcccgtactaagcagactgctcgcaagtcgaccggcggcaaggccccgaggaagcagctggccaccaaggcggcccgcaagagcgcgccggccacgggcggggtgaagaagccgcaccgctaccggcccggcaccgtagccctgcgggagatccggcgctaccagaagtccacggagctgctgatccgcaagctgcccttccagcggctggtacgcgagatcgcgcaggactttaagacggacctgcgcttccagagctcggccgtgatggcgctgcaggaggccagcgaggcctacctggtggggctgttcgaagacacgaacctgtgcgccatccacgccaagcgcgtgaccattatgcccaaggacatccagctggcccgccgcatccgtggagagcgggcttaagaagtggcggttcggccggaggttccatcgtatccaaaaggctcttttcagagccacccacatcagcacttggaagaagctgtaccgcttgccctccgtgctcctccggcattagagcggggaaggcacttccgcttaggctcccaacaaaacggggtcgggtccccctgctgcggtgccgtcttgagctttgccgacttcggccaattggcctatccgcactggccgggctgcggacgctttcctgggcgccggctcgcgggctttggcggtccggctccccccgcgcgtgaccggggccctgcgtggcgggggggccggggcaggagagacggggcgtcgggcacgaggccaggggtcactagggggacgctcagggctcgcggtcctgagcgcggctggcctttgcggaagtggagcgccacacgcccgtgcttcgcgcccaaaccggcctcacccggcgcggccatccggctagggagggaaatgaccacctcggcctcgccggggttctgcggacaaacgtggggagaactgcgctggggctgccgttcagtccccgcgccacctccactagcacagtggtaacccccatatcctgcccctaagccaaaattcccgggggcacggggtgtgggcggaattttgtgaatctgggctttatcgagccgttccctgtccatgtccacagaaggagattcactattccagtgaaggcactcggtcctcttagaagctgcatggtatgtctggattttctgtccagactcagtagttcctttacgttgttttcgtcggacatgtgggcagacgctggtgcccgagttcagatccttgggaagacagtagatcagacaggaagaacgtgggcctccgttgggcaaatgaagctcttcgccttaggaaatcgtgacaggaggccacagaggtgatctctacagtctctgggagctgggaagtccaaggcctcttagtgggaaagtgaggcagggtcttgcagagcccactctacacacggccagatacaaatggctgtagaggtcttagataacaccttctcggtcatttatttgcacctcagaagaagccagggcttcggttttctgtttgtttcatcacagttgacaggttaaaagcattcactgcagcgatctatgagaattaagaggggagaaggggaaatggaataaaacttcgttttgtaaagct

SEQ ID NO: 1100 - DNA, 1577 bp, Homo sapiens
gggcctcgccggcgccgtcaagtagcctgggggacaggccggcgcggctgggagcgggtgggcggccgggaggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagtcaggaccggcctctccgattcttacccgccttgctgtctgtctcttggatgttggcgtggcgtgggccacgcatggatccgtggccggaacacgcacacccagccaggctacagctccagagtatggatagctgccttctctccagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcaggaggagaa

SEQ ID NO: 1101 - DNA, 1247 bp, Homo sapiens
gctctacctcttggacttccaacttctgtgagtcaacatagtgcctcttgcatttaagaaacatctcatcacactcttatcagcattgagtttaaatttcaattagtgagaactgaggaaaaaccaagaagcctgcattccacagatcaagatgttgcagaggctccgcgttcttgtgagagtatgttccgagctctctgacctgtcaccatgggatcactcttttgaagagacttcctggaggacactgatgacatgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 1102 - DNA, 2172 bp, Homo sapiens
gccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatgg

SEQ ID NO: 1103 - DNA, 7986 bp, Homo sapiens
atgcggcacggcgtcgcctgggcgctgctggtggccgcggccctggggcttggggcgcgcggggtgcgcggcgcggtggcccttgccgacttctacccgttcggcgccgagcgcggcgacgccgtcacccccaagcaggacgacggcggctcggggctgcggccgctctcggtgcccttcccgttcttcggtgccgagcactccggactctacgtgaacaacaacgggatcatctccttcctgaaggaggtttctcagttcaccccagtggccttccccattgccaaggaccgctgcgtggtggcagccttctgggcagatgtggacaaccggcgtgcaggcgacgtgtactaccgggaggccaccgacccagccatgctgcgccgagccacggaggacgtcaggcactacttccccgagctcctggacttcaatgccacctgggtttttgttgccacctggtaccgagtgaccttctttggaggcagttcctcatcccctgtcaacacattccagactgtgctcatcacagacggcaagctctccttcaccatcttcaactatgagtccatcgtgtggaccacaggcacacacgccagcagcgggggcaacgccactggcctcgggggcatcgcagcccaggctggcttcaacgcaggcgatgggcagcgttacttcagtatccccggctcgcgcacagcagacatggccgaggtggagaccaccaccaacgtgggtgtgcccgggcgctgggcgttcagaatcgatgatgcccaggtgcgcgtggggggctgcggccatacaacgtccgtgtgcctggccctgcgcccctgcctcaacggcggcaagtgcatcgacgactgcgtcacgggcaacccctcctacacctgctcctgcctctcgggcttcacggggcggaggtgccacctggacgtgaacgaatgtgcctcccagccctgtcagaatggtgggacctgtactcacggcatcaacagtttccgctgccagtgcccggctggctttgggggacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactgcagctgcccctaccgcttcactgggaggcactgtgagatcgggaagccagactcgtgtgcctctggcccctgtcacaacggcggcacctgcttccactacattggcaaatacaagtgtgactgtcccccaggcttctccgggcggcactgcgagatagccccctccccctgcttccggagcccgtgtgtgaatgggggcacctgcgaggaccgggacacggatttcttctgccactgccaagcagggtacatgggacgccggtgccaggcagaggtggactgcggccccccggaggaggtgaagcacgccacactgcgcttcaacggcacgcggctgggcgcggtggccctgtatgcatgtgaccgtggctacagcctgagcgcccccagccgcatccgggtctgccagccacacggtgtctggagtgagcctccccagtgccttgaaatcgatgagtgccggtctcagccgtgcctgcatgggggctcttgtcaggaccgcgttgctgggtacctgtgcctctgcagcacaggctatgagggcgcccactgtgagctggagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttagggccctgctgcctgggaagaggtacaccatccagctgaccaccctcagtgggctcaggggagaggagcaccccacagagagcctggccaccgcgccgacgcacgtgtggacccggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacacgtccctggcaactgttcagaaaacccctgtcagaacggaggcacttgtgtgccgggcgcagacgcccacagctgtgactgcgggccagggttcaaaggcagacgctgcgagctcgcctgtataaaggtgtcccgcccctgcacaaggctgttctccgagacaaaggcctttccagtctgggagggaggcgtctgtcaccacgtgaaacaaagtaagagtcagacactggagaaatcttaaggatttaagacgttcttgttacactccaccaacctcacgagtttctaacacccaggaagatgaggtctaaaaactggatgaaaaaggacaccctgagaaaaggtcctagctggagtcagtcccctctgtgacctctctcctcaggcctctagaggacagatggccaggcctgtgcacacaccagcccaccctgagagacccctctgggaccaaccacctgtgagtcctgcgatgcgtttaagcagcctgtgccctcacccaagctgcagttcctgaaggtgtagtctgtgtctctgcggatgagatgacagctcgccattccccggaatcagtgaggctgtcagtcagccacgcttctgcagtatgcagaaacctgttcttagactccaaagccagagaaagaattctcccttcgaggcccaacaaattgagaaggaactgtgatggaccacttccaaaacagagacgggggcaggggctgaagggcagagaccaggtgatgtcagaaggaaagccgggttgcagacacagccgcccctgctctggtcctccagcgtgtttatgacgctcgtgcaggtcgacgagccatcctatggactagttaacactaaggtggagttcagacttttttagacaacggcgcgactggcagcctttctctatcaagggtcagacggtaaacgttttcagctttgcagaccagaggtccctgtggctacagtagcgcagacacagccacaggcatgtcattgaatggctgcggctatgttccaataaaaacttatttacaataacaggtggtggccaaattggcccatgggccttatttggtgaaccctgttctatgagatcacctaggcttcagccttaaacagtggaagccatcccctgaatgacaagtcacaagggtatcaaagaaagacccctgaattttcatggaaaaagctattcagacccctgcttggaaagctaaggcacactgccacgaagcagcaaggacgccttacaagtctcagtgcaacagagatggacacctgggctgggctggacaatgtttaaggttccttttagtccatgactcaagtgatactgttttaggctatcaggtagtaaacacgatcttagacatccccatctttgtaagcagaacagtacggcacttcaccacatctgcttcccaccatgcttctaagcagctgtcttccccctgctaatgttacaaccaaagcagccaccccacctcctctcgtgttgagcctcacgaccgctgacccagctggaaagccagcgccctgccgcgtcaccctgactctgctcagagccagcattccagccacaaagagggcctccttcctttcctctttcataaaaatgttttttgaagagttagagtatattttaggctttttatctttattaaaatttcatgtgcatgtgtctgtgtattctgcaatttgtcattttcagaaagaaggaacaggcaattcgcgaagtttcacctgtactcccgagctgttccccaggctccagacccacttgagagcagaaggtggagctcaatgaagggtctcgagctcagcgaagggtcactgggtgaactgagagaaaccacgttcacaaacgcgtactgcggacttcctgccgccctgggacctgtcactgtttgtccatgtaagctacagcattactagcagatgctaagatcgagtgatatcactggaaaagtaggtgaatcctactaggaaactttctactccctactaggacctcaagcccctcagccacacagcaaatgctaatatgctccagtgttagcttagaagccttgtgtcaacaagaactggctcctgagtcccaagcttggtgccacacagcaaatgctaatatgctccagtgttagcttagaagccttgtgtcaacaagaactggctcctgagtcccaagcttggtgccacacagcaaatgctaatatgctccagtgttagcttagaagccttgtgtcaacaagaactggctcctgagtcccaagtgctgtcacaggacttgcccattgggatgttttccacattaaatatcaagtaaaaagacttcctggtgctcaggaattacagttcgttcttgaaacattccaaagaggccaccacagcttttcccatgtggcttcttttaaaaactcaaatggcttccttgaaaatactcaaagtccacccaaggaaattagtaataatagaatcagaaaactgtcaggagcataaagatttctgtatcaaaatgaaagaagcaatcctgagttgctgaattacccatctgctaatgaaaccgggatggactgatcatctaaccaagtgcagactgaggattctacttagtcctccgactgggtacaacaacagcctaggttctagggagggtggcagtgaccgggatgccacaatggaagagaaaatgaaaacactggcacagtgaaatgtctcatttccaaacagttttgcctatggccaagcaaggcaataaagacaaactctcccttttccccattgcgtgtgggctgccaggtacaagtaagggaatctttgctgtgcccactgtcctccagtagagaacccaacaggcaagggccccactcaggtatcagctcacctcctgcacctccccttagcaggaactccttccactggcaaaggactgccactgccatctgactcaactgtggcgatgtggacggagtcaccgagctgcttttcttttgcaaaacaaaagtctttttctttgcagtcacgctgtaagacgaggctgctggagaaaacaaaagcacctagatttcagtgctgaatccccacaattgcatgcagctcacacctaccaggggtattccagtgcataggggaaaggaacccggctgaaaaaccagctccttatttttcttttaaataaaataatacgatcctaagtccatttaccatctgaagttgtcacgagtgaacagtcacattactgttgtggaccaggccttagatgagtttctcaggctcagcactgacattctgggccggatcatcctctcttgtgggaccatcctgtgcactgcaggatgtttcacagcacccctggcctctacccactagaatcctacaatctaccagatcctaggatctagttgatcctagaatgctaccaaggagacttgaattttggtcccatcatcaaaaatgccttctgcatcaatcctatgccagtttcccctaaaagagggctaactggaatgttctaggatgtaccaatcctccaggaccctcttagagctcatgccatcagagacaggcctctatctcagggatcaccccggctgacatcaaattcctcttctcttttcccaacatttcaaattgttcttcggactcattgagttccctaaggtgacacgcccccccccccccccacacccaccttggggggtcacggattgctccctgtggccctggcttcagcccacctgctccatgaccctatgctcttctcctctggttctcgaagctgtctgtaaccagggcaggggagataactgtatgggaccattccctggcctccacctgccccagcactctccaggccagcacagtctggcactacagactacagggccggagacaccaggcttggaagtgaccactggccaagagctgacataaaagccaacttccccaaacaggaagggcctgttcttcacaaagataaagaaaactgccagcattttgctggccttaagaagccatgcaaaattaaccagtacatcatgaattaacttcttttactctgctgtgcactgaataccattatgaagcaatatacttttggattaaaaataagcatttttgtggaaaatctgctacatgttttcataaaataaagtgctatgatgtactaaaa

SEQ ID NO: 1104 - DNA, 1346 bp, Homo sapiens
gcgcagcagccaggagcgcccacggagctggacccccagagccgcgcggcgccgcagcaggtgggtgacaccccgccccggccggccggagacccgagcccatcgccgtcagccagccagggccgcgcgggttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccggtgatcttgatagtggacaaagtgctcgagacccaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgcctggtcccagtaggtatcaggtctttctgtgcagctcagggagaccctaagttaaggggcagattaccaataaagaactgaatgaattcatccccccggccacctctctacccgtccagcctgcccagaccctctcagagg

SEQ ID NO: 1105 - DNA, 2921 bp, Homo sapiens
aagtaattgtccgtgtcaggaaggtaggcgtgccaagccgcggctctgcggagaaaccacgaccaccgcggccgccggaaacccaaagcgctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcaggcagctgtgggaagccgagagtcctggactgttcgtccgggtgccagcgctggcagtcccagtccgtccggtgcagcagcccggcgcattcccctctctccctccctcttgctctccctccctttctgtcttcctctctttcctcctctactgctccctccctctcttgcctcttaagtttcctgcaccgtgaatccaactgtgccaagccttggctcccgcgaaccaatcctgagcgcgacccgggcactgggacggcgactccgccaaagctggacgaggcagccggacccgtctgcgctcgagcatggagacggagcgcctgggagggcacgtccggggcgctggagacgccaggcccgagtagcttctccatggagcctgcccagagcggtcccttctcgcaggattcgccccaagtcctgtgcggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactgggaaaattgtagatcatggcaatgggacatttagtgtttatttcaggcataattcaactggtcaagggaatgtatctgtcagcttggtaccccctacaaaaatcgtggaatttgacttggcacaacaaaccgtgattgatgccaaagattccaagtcttttaattgtcgcattgaatatgaaaaggttgacaaggctaccaagaacacactctgcaactatgacccttcaaaaacctgttaccaggagcaaacccaaagtcatgtatcctggctctgctccaagccctttaaggtgatctgtatttacatttccttttatagtacagattataaactggtacagaaagtgtgccctgactacaactaccacagtgacacaccttactttccctcgggatgaaggtgaacatgggggtgagactgaagcctgaggaattaaaggtcatatgacagggctgttacctcaaagaagaaggtcacatctgttgcctggaatgtgtctacactgctgctcttgtcaactggctgcaaaatacactagtggaaaacactctgatgtaatttctgcccagtcagcttcatccctcagtataattgtaaatcatcacagattttgaattcacacctgaagacatgctctcacatatagaggtacacaaacacaccgtcatgcacatttcagcttgcgtctatcatgattcctgttgagagggctttcattgtctgactcataatggttcaggatcaactatcatcaaacggaaggattaactagacagagaatgtttctaacagttgctgttatggaaatctcttttaaagtcttgagtacatgctaatcaataatctccactcatgcattcctactgcttggagtagctgtactggtaaatactactgtaggagtatctgcttgttaaaatggaaaaatgtgtctttagagctcagtattctttattttacaaacacaacaaaatgtagtaacttttttccagcatacagtaggcacattcaaagtggtccaagatggctcttttttctttgaaaggggcctgttctcagtaaagatgagcaaacatttggaatttacatgtgggcagacattgggataacaactttcatcaccaatcattggacttttgtgaagttgacaccagctaaggctgcttaaaataagttctgatcattatataagaagggaaatgcctggcagacaccatgtaagttataagtgtctgtcttatctttactacacatattgtaacaaattcaatatcctagtcttcatttgtatgaatggtttgtattgtacatagtttaaccaagtgttatttgagctgcttattaatattaacttgtacttgtctctctgcttgttattggttaagaaaaaaggatatgaggaattcattttatcaatgtagctgtgaaggccattaaaaagacaaacttaatgtacagagcatttattcagatcaagtattgttgaaagctatacatatacaacattacagtctgtctgtatttagatattttatttctggaaaaaatgaaatgtacataaaaataaaacacttaaagttgagtttcaata

SEQ ID NO: 1106 - DNA, 5435 bp, Homo sapiens
ggcgcgctcgcatctggcgctgtccggagcccgctcgcgacgcacagggacgggaggcccggtttccacgggagaggctgcggactgcgggccccgtcccgaggccgggggagtgggagacacccggcgacccccgagaggcgattctggcagtggtggcggtggcggtggcggtggcggcctactcgccccctggaagcaccgccccgcctgggtggcgcgcgcgccggctcctcctcttcccctccgccgcggcccgccccggcccgcaaacccaaacactccaggcgcccgcccgccgcgcgtgattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtggtgctttgcatatcagttgatgtatctcaagactataaccaagtagagaatgtcataaaacaagcacaggagaaactgggtccagtggacatgctggtaaattgtgcaggaatggcagtgtcaggaaaatttgaagatcttgaagttagtacctttgaaaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatacaaggaaatttcaacagttcccttggctcagatgggtacatgctctcggccctgacctgtgggatggctccagtaacttctattactgaggggctccagcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctctctctctgtctctctgtctctctgtctctctgtctctctgtctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaaaattaaaaagtgtgactttttctcggagcatatatgtagcttttaggaaaggctgatgatggtataaagtttgctcattaagaaaaaaagacaaggctgattttgaagagagttgcttttgaaataaaatgatcacctgttctttatgtgactctcccactgaacctgcagacattatttttataccacatgctaaggaagcccactcatctaactctgtagccctggaaaccctcttggcccctgaatgttgtttccaggttataggatctgtgttcattagtggattttgacagcaagtgcctctgatgagttttagccaacattccccgttgcatcctgctcattgttcacactcctctgacttgaggagagctgccttcaccttgatcttgtaacctgtcttccttgcatatacggtagcacattccagatcacttcggtgagaaaagacctctgtttttgaagaggaaactttcttaaattgtaaaataaaacttaaaaaacataaaaactctatacaaaaattgaagacctaaaaattatagcataccttttttttgctcttgagtttttgaagctcttgactttaaatgacttaactttttaaaaaataagatgttttatggctttaacccatgtttttattaagatctgagaatagcatattttaaacactgatagatacagaagaaattattatttaatatataaattgcttggaatgatttcattgcagcttgtaaggatgggttgatgccagaatggtttcataaatctttcagtcttacagagccaaagtttgcagattatatcgagttgcgttgtgcagctgctaaaatggaatcatagctttttataatttgcagaaaacaattgcattaatgtctggatgtttctcagttttattcttttctcataaatgttcctcgaatgttggcaccttctactgctgatctatattagaatctagtccaagaaagtgtctgatttaataacattaaatagttatttcaatatattttttcaaattatcctcatagaacctgttgcctccagtgagatggtaatctactacccgaataaatttaagagcacctgttgagagcccctgttttgcggtagaagacaattgtccctatcccaatttccactgaaatatgagagcagatttgcagagaccatcatgtcagagaagaaatttccttgtcagagatgttaaagggctacagtcccttagcaaagaaacttcgaaatctaagttggtttgtgtttttctaaatttgataccgtaattcatttggcagcaaaatctgacttgaactgatgtgagagtattgtactttatatttatgctacttcattgtgacttaattttccctgaagaaatatccatggatttgattataggttttcccttagatgctgtggaggtgttttgtaatattcaaaatatgcccatattgcctttttaaaaccccaaagattatgaattctgaaacacatccagcccagcgggttttggataaggggttgtaggcatttaagcagcctcacataatgggctgacttcatccaaaacatgaaaatattacaaggcaaattctattttttatattttttggttcaatgcttgaacaacttgtttttctgctgggggaagaaaaaaagaaccaaccctgagtgtgattgttacggaaactaatgactttgtttttaaaggatcacattgattcaacaccttctattggacccagaagtgcgtaaatattacctatggtagtaaacgtttaattatcattcagtttaaatgttggccttctgtatgtagccaagaacagctcattttgtgaatttcagtttttaagtggctgctttttgatttggttgtattattttattataatgtatttgcaagtatattaaaaaattaacattgagccataaaaatccccaaatatgttcaaggacttcataattgaaaaatatatagaaaacaatccttacttctttttacaaaaacaaaatcatgggaattattcttttctatatatttagttataaatctttctctgggccgggcgtggtggctcacgccagtaatcccagcactttgggaggctgagacaggcgaatcacgaggtcaggagttcgagaccagcctggccaacatggtgaaaccccgtctctactgaaaatacaaaaaattagctggacacggtggcaggcgcctgtgtgtggcgggcgccagctactcaggaggctgaggcaggagaatcgcttgaacccaggaggcagaggttgcagtgagccaagattgcgccactgcactccagcctaggtgacagtgcgagactctgtctcaaaaaaaaaaaaaaagaaaaaaaatctttatctggatctgttaaaccatatattattgatcattgcaagtgaaattttgagagattgtttctagtatttaggtgatgaaaacatttggtaatattgctttggttcaaagaattttatgtctttatctttctagaagaaagcaattatatatatatttttgctaaattacataaacatttaattacatcaggttctaatttaaacatgtattactcacttgaggccacttttaaatattcatactctttgacataagatgctttgtatatttctcatttcttttagttcttagtaagtcagctttaaaaagtacctgccaaccagaaccttccatattctggactaaatcttgctcttcggattatacttcagtgcagtaactgtggatttgcaattttgaaggggagatagtagctattatattttacacttgcttgatgtgataactctaaagactttttaactgataaaagcgcacatggctattttgatacacaaagttgtgtttgctactttagaagcttttgtggcagaattgtaatctaattttcataccttgtatttctgaatcacaacaaaaaaataaatggggaacaagactta

SEQ ID NO: 1107 - DNA, 1737 bp, Homo sapiens
cgaatacaaagagccatacgaccttcggtttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataa

SEQ ID NO: 1108 - DNA, 1230 bp, Homo sapiens
ggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcagga

SEQ ID NO: 1109 - DNA, 3112 bp, Homo sapiens
gcgccgcgagcccggcgaagtcctcagcccgccccgcttgcccactccccacttcccgagccggctccgtgtttagggagggcagtgatcacgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccaagcaagcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgttggatttgttttcttttccgttttatatgtacaacaagggctttcttctcaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggtgcgaggatagctacaagccatggactttctgtcctgcttcttgtttgtggctttgtgaagggtgctttgctttaatctaaagtgctgacttttttccaatatcactttctcttcttaaagcaaagagcaaatcgcctgtaaaatctacggagcggacagcaaagttgaccctaaactccaagcaccaccctgcacccactgtactctaattcactacacaaggagcgcctgcttccggaagcataaatgaagaggctatcacatgctttgttgatcatattttctttggcaaaacactgatcttttattttaagagaattaacgtgaagtgatagaacgttttctaatagcaagatctattttttcccttttctttcggcgactaaaatcatctcactgactgctcaagggttggcctgaatgtcatcaggatagggaatatttactatggataccactaatttcctactaaaggacccagcatcttcaggaagcaaacagagatcaaaaggctacagaacagaagctatcatcagacaaaaccccctttttaggggaagaacaaaactatcaacactgcaagtcaacaaggaggacattactttaaggaataacatgagaaagaaatttttttattttcccctttttttcttggatttttcttctttttcttgattacagttcttgttcaatggtggcaagtgctggttatggccaatctccgtcaatcctaggaggtttatagaactacattttgagtgttctatatttcagtgtattttaattcattttgcaattcctgtgtatgcaaacctgataaattctgtaaattgcttatagtatgtgtgctataacttcaaagtagatgtactgcgaccctcatgcaagctgatttttatcattatatatataaatatatacttaagaatatctgtgtgttgggccaatgaccaactttttttgacgaagcatttgtttttcgttgataattcatacactgcgtgaattttgtaattcattgtttcacttccacaggtttgacagctgcagatggtctctattgtcctctgcttcattctggaaagtgcatattcaaaattgtatcagtctctgatcgatgaattaattttgttatgtctgtgctaagttggaatttactatgttcctttatacatggtgtttattgaggtttgagagtctcttgactgtgaagaatgtacactgtctggttttgacagctatttctgtattattatcattataatcttgtcaaatagaaatgttgcttctagaaaatttgcctaggaggcgaatgtggggaaggtgaagcactcaccataattccctaaattcatgttagaacatttcttgctatggttaaaaatgctgcttcctttgacctttatgaatttctgtacctttgtcattctgttacctttgtcattctgttatttgcgctaattatattttaatgtctcctaattaaaaattaaaatttggttgttggctaaatacaatatgcaaaagatgatggcaggtccccgactaaagaagattaatgtgttcagttttcactggttaagtgaattataattttaaatattccattcttatttatgtctttatgataattcagactattttattttgaacctgttttctactctggcaaagaaagataggcagaactattagtgttccatatacattatggaatagataaagcttgagagataaatgacctaagttttccttccagagagactcttccattttctctcattacaaaaccagaagatcagctatgtggggccatcagctcccagcctaaggtcctataacccgaagcttgaaggcaatcagtacctctgcttttcaaaggtaaatgcattcattttctttgattcagttataagcaagtatatattttcataatattcttgacattacctgagaaataatacttcatgctaaatcttttactgccacttttctcattcatttggtttatcatttcagtttaatgagaaaaattaataaaggttttgattgcactattttattaaccta

SEQ ID NO: 1110 - DNA, 600 bp, Homo sapiens
acaagcacatgaacatgaagccggccactgcctctgctctgctcctgctcctgctgggcctggcctggacccaggggagccacggctggggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 1111 - DNA, 1614 bp, Homo sapiens
cggcgccggaagcacgggtccgggccctcccgcggggcgggtactcgtctcccggccgagcgacttcagctcggggacctgccccatggccgctccccagcaggacagggaaaccgccgaggtggggggcttcttgtccgtcccagcccccccaactcaggccctctcgctgcccctggcgaccaccgcgtgcgcccttccccagggcgggcgcagtcctggacgcctccgccgagcgtgactgcgtgcattttctctcctttcccttcccaacctgcggagagaagacagccccagagccgctgtctccatcctctgctgatgcctgctgtctttatgttggcctcgtcgtccgcactgcagtgtggcaggggcgtccctcgtttcccgcggactgaggtgggcgccgggcattcagtaaacgaagaaaccaaagcggagaaggttgggaatcaaacgtctgtcatacctgccaccagcagacaagcggctttgggtacctcctggacccaaagacgaactcagcccctccaggagcgcagtcattggcaccctcgtgggaacaatgccagtgggatgggtggccaccggatgtttccggggcccctcagaggcccagcagcgcaggtcttggagaatgaatgtgggtcactgggccgcgctgcagagggccggtcctgagtcgcttcctggaggagaggcccatggccagcacttggcttcgcctggaggaagaagcacgtgctaaaccacgagcgttcagggtttgtctgtttgataaaagatgctggctttgacacaccaactgacaaagtctttcataggttggagctgctaggttgtgcccctgcccctcctgaaaattagccacacgaaaggaagggtctggaaggtggcagggaagccagcagagaccagggaagtggcagcagcatggggcaggggcacacaggaaggagatggagcttgcgggagcccccactgccactccgacagggagccctgccccgtgccctgctgatgttgacactgaccccggctctattatttcagtttttccttgtaatttctgaaaatctagcaacaagttgagcaatgaaaaaaagtaaaaaagttaaaattgtgttagaaattatgactgtaaagaaattttgaaactaatgaagaaaaaattgccaaaattgccaaagcttttaggactcttaaaaatatagtaacattgagtattatgaactaaagactcatactattatatcagtgtctggtagtgaatttggatggaggactgtctagtaacttcttaacaaaacattgattagaagtctttcttggcggggcgccgtggctcacgcctgtaatcccagcactttgggaggcgaggcaggtagatcatgaggtcaggagatcgagaccatcctggctaacatggtgaaaccccgtctctactaaaaaaaatacaaaaaaactaggcaggtgtggtggtgggcccctggagtcccagctactcgggaggctgaggcaggagaatggcgtgaacccgggaggcggagcttgcagtgagccaagatcgcgccactgtactccagcctgggcaacagagcgaggctccgtctc

SEQ ID NO: 1112 - DNA, 778 bp, Homo sapiens
tggaagataagattccccgccatgttatcctccgtggtgttttggggactaattgccctcattggcacttccaggggctcataccccttcagtcactcaatgaagcctcacctacatccacgcctgtaccacggctgctatggggacatcatgaccatgaagacctctggggccacttgtgatgcaaacagtgtgatgaactgcgggatccgtggttctgaaatgtttgctgagatggatttgagggccataaaaccttaccagactctgatcaaagaagtcgggcagagacattgcgtggaccctgctgtcatcgcagccatcatctccagggaaagccatggcggatctgtcctgcaagacggctgggaccacaggggacttaaatttggcttgatgcagcttgataaacaaacgtaccaccctgtcggtgcctgggatagcaaagagcacctttcacaggctactgggattctaacagagagaattaaggcaatccagaaaaaattccccacgtggagtgttgctcagcacctcaaaggtggtctctcagcttttaagtcaggaattgaagcgattgccaccccatcggacatagacaatgacttcgtcaatgatatcattgctcgagctaagttctataaaagacaaagcttctaggcaaagctctgtgggtgggccaggttggcagagtgctcagatggccgcctttgagagttttacgtgaatgtgttgtatacaacactggcaaagaaatgattaaaatcatgaaagaaaa

SEQ ID NO: 1113 - DNA, 427 bp, Homo sapiens
gcatgcgcgttgcgcgccggacgcggaacgtctgccggtgtccccgcgctgctggtcccggggtccctgaaccgcgggcggccccgctccctctgctggccatggcccccccgcccgcgtgccggtccccgatgtcaccgccgccgccgccgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggca

SEQ ID NO: 1114 - DNA, 961 bp, Homo sapiens
cggggcccggcgtcaagctccgcctccgcgccccattggctggcatcacctccgcgcgcctgactgacagcgcgcataggggcggggcgccgccaccgcttccgccgggccatggggccgcgcgtgctgcagccgccgctgctgctgctcctgctggcgctgctgctggcggcgctgccgtgcggtgccgaagaggcctcgccgctgcgccccgcgcaggtcacgttgtcgccgccgccggccgtgacgaacgggagccagccgggcgcgccacacaacagcacgcacacgcgtccgccgggggcgtcgggctcggcgctgacgcgctccttctacgtgatcctgggcttctgcggcctgaccgcgctctacttcctgatccgggcgtttaggttgaagaagcctcagcggaggcgatacggcctcctcgccaacactgaggaccccacggagatggcctcgctggacagcgacgaggagacggtgtttgagtcccggaatctgagatgatgctgagccagggaggcggcccttccagcagccatgagggaaggacaggagatggggcccaccccagtgcccagcaaccccctgctccaccgctcattcccctgctggccccggggctggtctcacccagtgccaacccgagagctccttttggaacctgcacagcccgccgacctgttgccacctgcacccaccgctggaccatgcagcctcgcctcctggatgctgtcccagcctggccgagggtcccaggtgaagactggagggaccccaacagccaccgcccaggacgctgaggctcccttgcctgactgtgacttgtgcctctctcctgcccccgtggggacatggcagcccagagccaaggctgggtgggcaggtgacccaaggaacctttctgggaacaccttctcgccgggctgggaacaataaatgcagccatgtctctgca

SEQ ID NO: 1115 - DNA, 1038 bp, Homo sapiens
gttgctatgttgcccaggctggtcttgaagtgccttgacctcctaaagtgttggaaccacagacgtgagccactccacccagcctaaaacttcatcttctttggatgagatgaacacttttaacaagagaacaggactctatataaatcgctgtgggctcaccacctctaaggaggagcactgactgaagacagaaaaattgatgaactgaagaagacatggtccattatgccttacaaacttacacagtgctttgggaattccaaagtactcagtggagagaggtgtttcaggagccgtagagccagatcgtcatcatgtctgcattgtggctgctgctgggcctccttgccctgatggacttgtctgaaagcagcaactggggatgctatggaaacatccaaagcctggacacccctggagcatcttgtgggattggaagacgtcacggcctgaactactgtggagttcgtgcttctgaaaggctggctgaaatagacatgccatacctcctgaaatatcaacccatgatgcaaaccattggccaaaagtactgcatggatcctgccgtgatcgctggtgtcttgtccaggaagtctcccggtgacaaaattctggtcaacatgggcgataggactagcatggtgcaggaccctggctctcaagctcccacatcctggattagtgagtctcaggtttcccagacaactgaagttctgactactagaatcaaagaaatccagaggaggtttccaacctggacccctgaccagtacctgagaggtggactctgtgcctacagtgggggtgctggctatgtccgaagcagccaggacctgagctgtgacttctgcaatgatgtccttgcacgagccaagtacctcaagagacatggcttctaacatctcagatgaaacccaagaccatgatcacatatgcagcctcaaatgttacacagataaaactagccaagggcacctgtaactgggaatctgagtttgacctaaaagtcattaaaataacatgaatcacattaaa

SEQ ID NO: 1116 - DNA, 1505 bp, Homo sapiens
ggaaaagtagcctaaagtcagtataactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaagggtaagtggggcccaggggcagggagggaggaaggggtaactgagtccaggaagggggtggagcgtggccatggataatcgggcttcctactggcccagggtatttgagagtgacccagtgcctccatccctccttctgcctccccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgttt

SEQ ID NO: 1117 - DNA, 998 bp, Homo sapiens
gtgtgctagtaagtgtgcacgtacgatggaaaatgaatgaagaatgaggacattccaccactctccaagttatcaagatgaagacccaagatggtggcattcactctgaaggtagcctggaaagtgggagacacgctttgcccactccctgtggttgactagagcccccagcccagtgcagcctaggggtgtaaggatcaagatccattcaataagagacccttcctcccaagctgtgagctgtgggtgccagttagtcccatttgtgaccttgggaacttagtgttcccagcaagaaagggggtggctggcttgtctccagttcttatatccaaggtgcagcagctgagcattccaaattcgggaaccaccagaaaggctggcctctcttcaacatgggatcttctggacttttgagcctcctggtgctattcgtcctcttagcgaatgtccagggacctggtctgactgattggttatttcccaggagatgtcccaaaatcagagaagaatgtgaattccaagaaagggatgtgtgtacaaaggacagacaatgccaggacaacaagaagtgttgtgtcttcagctgcggaaaaaaatgtttagatctcaaacaagggaaacaataacaacttccaatccaaagccaactgcctgaacacctgcaagaataaacgctttccctgattggataaggatgcactggaagaactgccagaatgtggctcatgctctgagtactgttcctgtacctgacggatgctccagactggcttccagtttcactctcagcattccaagatcttagcccttcccagaacagaacgcttgcatctacctcctcttcctccatctttggctcttttgatgcacaatatccatccgttttgatttcatctttatgtcccctttatctccaacttctagaactcccagtttatacctgtgtcactctcaattttttccagtaaagtacttgatgtagtcctgtgccttga

SEQ ID NO: 1118 - DNA, 766 bp, Homo sapiens
ggagaaaatgcccctggaaagggttaagggccaggacaggaatggggcaggaggtgcacggatcctgctgggcactgggagcagggggcggccaaaggcagtgggtgggcaggtccatgcctcccctggccccccagctctgcagggcagtgttcctggttcctatcttgctgctgctgcaggtgaagcctctgaacgggagcccaggccccaaagatgggagccagacagagaaaacgccctctgcagaccagaatcaagaacagttcgaagagcactttgtggcctcctcagtgggtgagatgtggcaggtggtggacatggcccagcaggaagaagaccagtcgtccaagacggcagctgttcacaagcactctttccacctcagcttctgctttagtctggccagtgtcatggttttctcaggagggccattgaggcggacattcccaaatatccaactctgcttcatgctcactcactgaccctccctccctcctgggctccaggtcacaactcccaaaggagatgcaggcatggctctctgcctctgatcaccatcactgtatctcaaggttcagcagcagagataccagttgccatcagtgctaactgactgcctctccaggttcggagtttcatctcccagggccagagacagcagacccacatccttctctcccacacctctcctggttttgttcaggacagcagattagaggcaggaggcaatgacaataaaataacgataaaatcctgagaacaa

SEQ ID NO: 1119 - DNA, 2042 bp, Homo sapiens
gtctgtccgccgtctcagactagaggagcgctgtaaacgccatggctcccaagaagctgtcctgccttcgttccctgctgctgccgctcagcctgacgctactgctgccccaggcagacactcggtcgttcgtagtggataggggtcatgaccggtttctcctagacggggccccgttccgctatgtgtctggcagcctgcactactttcgggtaccgcgggtgctttgggccgaccggcttttgaagatgcgatggagcggcctcaacgccatacagttttatgtgccctggaactaccacgagccacagcctggggtctataactttaatggcagccgggacctcattgcctttctgaatgaggcagctctagcgaacctgttggtcatactgagaccaggaccttacatctgtgcagagtgggagatggggggtctcccatcctggttgcttcgaaaacctgaaattcatctaagaacctcagatccagctgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttggatattggaatggtgccgataagaagggacgcttccttccgattactaccagctatgactatgatgcacctatatctgaagcaggggaccccacacctaagctttttgctcttcgagatgtcatcagcaagttccaggaagttcctttgggacctttacctcccccgagccccaagatgatgcttggacctgtgactctgcacctggttgggcatttactggctttcctagacttgctttgcccccgtgggcccattcattcaatcttgccaatgacctttgaggctgtcaagcaggaccatggcttcatgttgtaccgaacctatatgacccataccatttttgagccaacaccattctgggtgccaaataatggagtccatgaccgtgcctatgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccgggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctcaaaaaaaaaaaaaaaaa

SEQ ID NO: 1120 - DNA, 2324 bp, Homo sapiens
caaacctcgtcccaactcccacccaccggcgtttctccagctcgatctggaggctgcttcgccagtgtgggacgcagctgacgcccgcttattagctctcgctgcgtcgccccggctcagaagctccgtggcggcggcgaccgtgacgagaagcccacggccagagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaaggagtatgctggattcatggaactctaattctgtacataaaaattttaaagttatttgtttgctttcaggcaagtctgttcaatgctgtactatgtccttaaagagaatttggtaatttggttgatgtggtaagcagataggtgagttttgtataaatcttttgtgtttgagatcaagctgaaatgaaaacactgaaaaacatggattcatttctataacacatttatttaagtatataacacgttttttggacaagtgaagaatgtttaatcattctgtcatttgttctcaatagatgtaactgttagactacggctatttgaaaaaatgtgcttattgtactatattttgttattccaattatgagcagagaaaggaaatataatgttgaaaataatgttttgaaatcatgacccaaagaatgtattgatttgcactatccttcagaataactgaaggttaattattgtatatttttaaaaattacacttataagagtataatcttgaaatgggtagcagccactgtccattacctatcgtaaacattggggcaatttaataacagcattaaaatagttgtaaactctaatcttatacttattgaagaataaaagatatttttatgatgagagtaacaataaagtattcatgatttttcacatacatgaatgttcatttaaaagtttaatcctttgagtgtctatgctatcaggaaagcacattatttccatatttgggttaattttgcttttattatattggtctaggaggaagggactttggagaatggaactcttgaggactttagccaggtgtatataataaaggtacttttgtgctgcattaaattgcttggaaaatgttaacattatattatataagagtatcctttatgaaattttgaatttgtataacagatgcattagatattcattttatataatggccacttaaaataagaacatttaaaatataaactatgaagattgactatcttttcaggaaaaaagctgtatatagcacagggaaccctaatcttgggtaattctagtataaaacaaattatacttttatttaaatttcccttgtagcaaatctaattgccacatggtgccctatatttcatagtatttattctctatagtaactgcttaagtgcagctagcttctagatttagactatatagaatttagatattgtattgttcgtcattataatatgctaccacatgtagcaataattacaatattttattaaaataaatatgtgaaatattgtttcatgaaagacagatttccaaatctctcttctcttctctgtactgtctacctttatgtgaagaaattaattatatgccattgccaggtagaagtttggaataattgtttagtctctcctattagatgtggacatttttgtttttgtttttgttttcagggatgaaataaaatatattatttctacct

SEQ ID NO: 1121 - DNA, 785 bp, Homo sapiens
aaaccataccatatcccaccagagagtcgcagacactatgctgcctcccatggccctgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtagcagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttctgtttcttcctccccgctgtcatttcagtctcttcattttgtcatacggcctaaggctttaaagagcaataaaatttttagtctgca

SEQ ID NO: 1122 - DNA, 1051 bp, Homo sapiens
cgggctcagagcgcacccagccggcgccgcgcagcactgggaccctgctcgccctgcagcccagccagcctgctccgcatccccctgctggtctgcccgccgacctgcgcgccctcgctgccgcccgtgtgcgcccctcgaccccagcggcaccatgcatctctcccagctgctggcctgcgccctgctgctcacgctgctctccctccggccctccgaagccaagcccggggcgccgccgaaggtcccgcgaaccccgccggcagaggagctggccgagccgcaggctgcgggcggcggtcagaagaagggcgacaaggctcccgggggcgggggcgccaatctcaagggcgaccggtcgcgactgctccgggacctgcgcgtggacaccaagtcgcgggcagcgtgggctcgccttctgcaagagcaccccaacgcgcgcaaatacaaaggagccaacaagaagggcttgtccaagggctgcttcggcctcaagctggaccgaatcggctccatgagcggcctgggatgttagtgcggcgccccctggcggcggatcgggaactggctccgttgtgctgaggtcatctttggtcatcagcctccagcatctggaaacacctccaacgcaatgtggcttttacatttctttctttctttctttttttttcctggtactgggaatacacaacaccagctgttttattattatttggggagggggttgtgattttattatttgtttttttaaaatgaaaaataaaaagttatatattatatatatattatatacatgaaacacacacacctacaccgacttgatgacaagggacagtttttaagagactgacagaaccagctgtaaaacattgctgtttgtaaattcatgtcatgcataaatgtatttatgttgtaaagctatttatattgtttataaagagatatttataaaaattttatttatgtaactaaatgaaagaagtcaatcattgtaatgtttttgtcctaactagttaaaaaaaatgtaaaaaaaaaaaagtcattccatgaa

SEQ ID NO: 1123 - DNA, 477 bp, Homo sapiens
ccggggtccctgaaccgcggtaagggcggtggtgcgggcgtccgaatgggcgttttctagatacggggcgcggactagaggctcgctgggcccggagaccggcggactggagtcggggaaccggagggcggccccgctccctctgctggccatggcccccccgcccgcgtgccggtccccgatgtcaccgccgccgccgccgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggca

SEQ ID NO: 1124 - DNA, 890 bp, Homo sapiens
ggtgatcttggttacttaaaggctctaagcttgagttttctcatccatcaaaacacacacctgactaggtaatgctccagtgacttaataccaatgacattttcatgttgtccacaaattctgagtagaaaccttttcaagcctgtagcctctctgagagctgactgttattaactgaatgagaggatgtcagcaaacagagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaa

SEQ ID NO: 1125 - DNA, 522 bp, Homo sapiens
aacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctagattctcacctgctacacacccctcagagggactggaggaatccagacaacgatgcgcaggg

SEQ ID NO: 1126 - DNA, 950 bp, Homo sapiens
atgcagaccttcccagttgctggggcgctggaccctgctatactggacacaaggtaggagcactcagaagggacaccgtcatctgctgctgtcgccatggcgattattcaacgccctgcctcttcaccccaggaaaaccttcgcggaacccgtcaccatggaaacgaactctctggactcttagcgcgccctgggctggccctgctgggtggacaggagaggagcaaaacgcaacaaagacgggattaattactcggaggccgcgccccctccgaagaaggccccaccctgccccggcctcacccctccccgaaataattcgaggaaatattccgcgaatgctgggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtt

SEQ ID NO: 1127 - DNA, 684 bp, Homo sapiens
atgggggccgtcatgggcaccttctcatctctgcaaaccaaacaaaggcgaccctcgaaagacatcgcctggtggtattaccagtatcagagagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaa

SEQ ID NO: 1128 - DNA, 1361 bp, Homo sapiens
cctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgc

SEQ ID NO: 1129 - DNA, 596 bp, Homo sapiens
gaaccctgagccgcctgcgcggatcggcgtccgcagcgggcggctgctgaggggtgactgttctttcagctcccagcactggagcgctcggcccctgccgcactggatgccagcagttactaaaagtgagcctggcatttcagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccac

SEQ ID NO: 1130 - DNA, 496 bp, Homo sapiens
agtccagcgtctcctgggcctagattccccagctgctgttctctggaggggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccg

SEQ ID NO: 1131 - DNA, 3971 bp, Homo sapiens
gacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1132 - DNA, 1533 bp, Homo sapiens
tacttaggaagcctgtggtgagaacaacaacagtgcctgagaatcccacggctctggggaagtgagccccgaggatgaggctgctcgcctggctgattttcctggctaactggggaggtgccagggctgaaccagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggacatggtgacctacttcatgaacctgagccaggcgaatgctcaggggacgccgcgctgggagctcgagtaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccgcgcctgaggagtgaactgaaataggacaaccgaatcaggaagcgaagccccaggagctgcagccatccgtgatcgcgccactgcactccagcctgggtgacaaagccagactctctccaaaaacaaaccagaaacagaaaagaaatgacgacccaagacccccctacaagcatacttcttttgcgtattatgtttaactcacaaaacaaagctcatcatgcgtttg

SEQ ID NO: 1133 - DNA, 561 bp, Homo sapiens
gtcgcggccgggaagcgtgggaggaggcccagcggcgagctggctttctcctggccacttgccggggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatg

SEQ ID NO: 1134 - DNA, 930 bp, Homo sapiens
tgcacccagcccatgttcacattttaattgtggaagccaggtgacggatggtggcaccatcaagcaaaagatcttcaccttcgacgccatgttctccaccaactactcacacatggagaactaccgcaagcgagaggacctggtgtaccagtccactgtgaggctgcccgaggtccggatctcagacaatggtccctatgagtgccatgtgggcatctacgaccgcgccaccagggagaaggtggtcctggcatcaggcaacatcttcctcaacgtcatggctcctcccacctccattgaagtggtggctgctgacacaccagcccccttcagccgctaccaagcccagaacttcacgctggtctgcatcgtgtctggaggaaaaccagcacccatggtttatttcaaacgagatggggaaccaatcgacgcagtgcccctatcagagccaccagctgcgagctccggccccctacaggacagcaggcccttccgcagccttctgcaccgtgacctggatgacaccaagatgcagaagtcactgtccctcctggacgccgagaaccggggtgggcgaccctacacggagcgcccctcccgtggcctgaccccagatcccaacatcctcctccagccaaccacagagaacataccagagacggtcgtgagccgtgagtttccccgctgggtccacagcgccgagcccacctacttcctgcgccacagccgcaccccgagcagtgacggcactgtggaagtacgtgccctgctcacctggaccctcaacccacagatcgacaacgaggccctcttcagctgcgaggtcaagcacccagctctgtcgatgcccatgcaggcagaggtcacgctggttgcccccaaaggacccaaaattgtgatgacgcccagcagagcccgggtaggggacac

SEQ ID NO: 1135 - DNA, 1140 bp, Homo sapiens; identical to SEQ ID NO: 240

SEQ ID NO: 1136 - DNA, 1346 bp, Homo sapiens
gattggccggggggatgcgggggatgcgggcggcggggttaagcgcgtcgccaccgcccccgcctaggcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctgggctggtttacaacaaaacatccagggccacccagtttcctgatggtgtggatgtacgtgtccctggctttgggaagaccttctcactggagttcctggaccccagcaaaagcagcgtgggttcctatttccacaccatggtggagagccttgtgggctggggctacacacggggtgaggatgtccgaggggctccctatgactggcgccgagccccaacggcagccgcaggcctggaaggacaagtatatccgggccttcgtgtcactgggtgcgccctgggggggcgtggccaagaccctgcgcgtcctggcttcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctc

SEQ ID NO: 1137 - DNA, 2179 bp, Homo sapiens
tacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtagatggagatctcaatctggggtcggtggttaaggagagctgcgagcccagctgctgagcaggggtgggacatgaaccagcggatggagtccagcaggggagtgggaaagtgggcttgtgctgctgcctagacagtagggatgtaaaggcctgggagctagaccctccccaagcccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtga

SEQ ID NO: 1138 - DNA, 1235 bp, Homo sapiens
taagatgcggaggagggtgacgcactagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagcattggca

SEQ ID NO: 1139 - DNA, 1196 bp, Homo sapiens
aaaaaccttccacccgtcagtctagaaggataagagaaagaaagttaagcaactacaggaaatggctttgggagttccaatatcagtctatcttttattcaacgcaatgacagcactgaccgaagaggcagccgtgactgtaacacctccaatcacagcccagcaaggtaactggacagttaacaaaacagaagctgacaacatagaaggacccatagccttgaagttctcacacctttgcctggaagatcataacagttactgcatcaacggtgcttgtgcattccaccatgagctagagaaagccatctgcaggtgttttactggttatactggagaaaggtgtgagcacttgactttaacttcatatgctgtggattcttatgaaaaatacattgcaattgggattggtgttggattactattaagtggttttcttgttattttttactgctatataagaaagaggtgtctaaaattgaaatcgccttacaatgtctgttctggagaaagacgaccactgtgaggcctttgtgaagaattttcatcaaggcatctgtagagatcagtgagcccaaaattaaagttttcagatgaaacaacaaaacttgtcaagctgactagactcgaaaataatgaaagttgggatcacaatgaaatgagaagataaaattcagcgttggcctttagactttgccatccttaaggagtgatggaagccaagtgaacaagcctcagtgacacaagtcaaattcatagtttcactctgggttttttgttgttgtgtggttattattctcactacagaaagactgagtttcatgctcctggctatgtcagatgtgaattttcatgggaataataatcaaccttgcagcaagccaaagcaatgcctcgcttgggttcttcatgttcttactacccagcgttttttaccacctagatgggcctctctaagtctatttgctcaatgaaccttatcccaaacttgttgttttcatggtgtctgaaagaatgtgatgtcagcttttagaatgaaatcagtgttaaggtacctccagtgaaccaaacatgtgtcttaaatctaagccactgaaaacagaagggaatgtccaaggcaaatacaaatcatacacagcttgtaacaacatacagcctttctatgtgaaataatggaataaactaaagagtttctg

SEQ ID NO: 1140 - DNA, 2443 bp, Homo sapiens
atggggaaactgaggcctgggagagtggagtggctggcctcaggccacacggaaaggccccacctcttccagaacctcctgctcttcctgtgggccctgctgaactgtggtttgggggtcagtgctcagggtccgggcgagtggaccccgtgggtgtcctggacccgctgctccagctcctgcgggcgtggcgtctctgtgcgcagccggcgctgcctccggcttcctggggaagaaccgtgctggggagactcccatgagtaccgcctctgccagttgccagactgccccccaggggctgtgcccttccgagacctacagtgtgccctgtacaatggccgccctgtcctgggcacccagaagacctaccagtgggtgcccttccatggggcgcccaaccagtgcgacctcaactgcctggctgaggggcacgccttctaccacagcttcggccgcgtcctggacggcaccgcctgcagcccgggtgcccagggggtctgcgtggctggccgctgccttagcgccggctgtgatgggttgttgggctcgggtgccctcgaggaccgctgtggccgctgcggaggcgccaacgactcgtgccttttcgtgcagcgcgtgtttcgtgacgccggtgccttcgctgggtactggaacgtgaccctgatccccgagggcgccagacacatccgcgtggaacacaggagccgcaaccacctggcactgatggggggcgatgggcgctacgtgcttaatgggcactgggtggtcagcccaccagggacctacgaggcggccggcacgcatgtggtctacacccgagacacagggccccaggagacattgcaagcagccgggcccacctcccatgacctgctcctacaggtcctcctgcaggagcccaaccctggcatcgagtttgagttctggctccctcgggagcgctacagccccttccaggctcgtgtgcaggccctgggctggcccctgaggcagcctcagccccggggggtggagcctcagccccccgcagcccctgctgtcacccctgcacagaccccaacgctggccccagacccctgcccaccctgccctgacacccgcggccgcgcccaccgactactccactattgcggcagtgactttgtgttccaggcccgagtgctgggccaccaccaccaggcccaggagacccgctatgaggtgcgcatccagctcgtctacaagaaccgctcgccactgcgggcacgcgagtacgtgtgggcgccaggccactgcccctgcccgatgctggcaccccaccgggactacctgatggctgtccagcgtcttgtcagccccgacggcacacaggaccagctgctgctgccccacgccggctacgcccggccctggagccctgcggaggacagccgcatacgcctgactgcccggcgctgtcctggctgagcccctgcaggagccccggccacacacagcaagaaagatacatctgaccagcctcaacgtcaacgtatttcccctctcaccctggcttccaggcagctctgaaatacgtcccacctgtgcagctatgtgactccctcccacacacgcttaagacacctctgcatgcagtcaaagccactgtcacaagccggcaggcactggtgaggaggcactaaggagactctgacttttatttcgcctctctccttggctgccaggaagctcatagctatttatactcagaaagtttaacgctgctttctttctctttgcgcgcgtcacacttgcttggagacactgtcatgaacgagcatgacaccctgctgccctgggtacccagaagatcatctgtttacttcccagacactgtgctgtctctgctctctgctactcacacacaccctcatgtgtgaagggcagagacactgtcacaaacaggcatgccccttagaagacatgcctaaccaggcactgtaacgtaccaacgtaccaatttccccttttcccctggctaccaggaaactcggagacaatcttttcagcctcagcatttctggctggatttccacccatcaacacgtgcttgctcctcctttttttttttttctgaggtagacccttgctctgtcacctaggctgaagtgcggtggtgcaatcatggctcactgcagcctcaaattcctgggctcaagcgatcctcccacctcagcctccacagcagctggaactccaggtgtgaatcaccatgcccggctaacttttaaattttttgtagagatggggtcttgctacgttgcccacactgctctccaactactggcctcaaacgatcctcctgcctcggcctcccaaagcactggaatttcaggcatgcactatcgtactggctgttcaccccccttttattcctctttaatttttacaagcactttttaaaaaaaaattttactttaagttc

SEQ ID NO: 1141 - DNA, 772 bp, Homo sapiens
attgctgggcggttcttgccggaagcggagagcggctgatcgcagtccggaggtgaggcggaactctgaggcagatatcctccctttcctcctcggctgctgctcttactttgacaagccaggctaacattgaagcaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagc

SEQ ID NO: 1142 - DNA, 1479 bp, Homo sapiens
tctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaac

SEQ ID NO: 1143 - DNA, 2403 bp, Homo sapiens
cacatgccccgtttgctgcctgaacctctccacaaagactcccagatcctgtagaattgaatttaatcatctcctgacaaaagaatgcaatttcaactgaccctttttttgcaccttgggtggctcagttactcaaaagctcaagatgactgcaacaggggtgcctgtcatcccaccactggtgatctcctggtgggcaggaacacgcagcttatggcttcttctacctgtgggctgagcagagcccagaaatactgcatcctcagttacctggagggggaacaaaaatgcttcatctgtgactctagatttccatatgatccgtatgaccaacccaacagccacaccattgagaatgtcattgtaagttttgaaccagacagagaaaagaaatggtggcaatctgaaaatggtcttgatcatgtcagcatcagactggacttagaggcattatttcggttcagccaccttatcctgacctttaagacttttcggcctgctgcaatgttagttgaacgttccacagactatggacacaactggaaagtgttcaaatattttgcaaaagactgtgccacttcctttcctaacatcacatctggccaggcccagggagtgggagacattgtttgtgactccaaatactcggatattgaaccctcaacaggtggagaggttgttttaaaagttttggatcccagttttgaaattgaaaacccttatagcccctacatccaagaccttgtgacattgacaaacctgaggataaactttaccaagctccacacccttggggatgctttgcttggaaggaggcaaaatgattcccttgataaatactactatgctctgtacgagatgattgttcggggaagctgcttttgcaatggccatgctagcgaatgtcgccctatgcagaagatgcggggagatgttttcagccctcctggaatggttcacggtcagtgtgtgtgtcagcacaatacagatggtccgaactgtgagagatgcaaggacttcttccaggatgctccttggaggccagctgcagacctccaggacaacgcttgcagatcgtgcagctgtaatagccactccagccgctgtcactttgacatgactacgtacctggcaagcggtggcctcagcgggggcgtgtgtgaagactgccagcacaacactgaggggcagcactgcgaccgctgcagacccctcttctacagggacccgctcaagaccatctcagatccctacgcgtgcattccttgtgaatgtgaccccgatgggaccatatctggtggcatttgtgtgagccactctgatcctgccttagggtctgtggccggccagtgcctttgtaaagagaacgtggaaggagccaaatgcgaccagtgcaaacccaaccactacggactaagcgccaccgaccccctgggctgccagccctgcgactgtaacccccttgggagtctgccattcttgacctgtgatgtggatacaggccaatgcttgtgcctgtcatatgtcaccggagcacactgcgaagaatgcactgttggatactggggcctgggaaatcatctccatgggtgttctccctgtgactgtgatattggaggtgcttattctaacgtgtgctcacccaagaatgggcagtgtgaatgccgcccacatgtcactggccgtagctgctctgaaccagcccctggctacttctttgctcctttgaatttctatctctacgaggcagaggaagccacaacactccaaggactggcgcctttgggctcggagacgtttggccagagtcctgctgttcacgttgttttaggagagccagttcctgggaaccctgttacatggactggacctggatttgccagggttctccctggggctggcttgagatttgctgtcaacaacattccctttcctgtggacttcaccattgccattcactatgaaacccagtctgcagctgactggactgtccagattgtggtgaacccccctggagggagtgagcactgcatacccaagactctacagtcaaagcctcagtcttttgccttaccagcggctacgagaatcatgctgcttcccacacccatctgtttagaaccagatgtacaatattccatagatgtctatttttctcagcctttgcaaggagagtcccacgctcattcacatgtcctggtggactctgctgcagtgcagtggcacaatctcggctcactgcaacctccgcctcctgagtgcaagcaattctcctgcttcagcttcccgagtagctgggattacaggcacccgccaccacacctggctaatttttgtatttttagtagagatggggtttcaccacattggccaggctggtctcaaactcctgacctcaggtga

SEQ ID NO: 1144 - DNA, 2735 bp, Homo sapiens
ctcaaggctcctccacacacacacccgctgaaccctgagcaccctgagctgctgagatggggcgggccggggctgccgccgtgatcccgggcctggccctgctctgggcagtggggctggggagtgccgcccccagcccccaccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggcaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagcc

SEQ ID NO: 1145 - DNA, 465 bp, Homo sapiens
ctatttatgttgcacaagattgtacaggtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgaggtcattttgtgatccagtattttaattcagaaaaatttgagaatacataaatgaaacatgtaattattacatggttttgattgttttcccagttggtgcttttacagactaaagtaattttacagaataaaataacttaaatca

SEQ ID NO: 1146 - DNA, 873 bp, Homo sapiens
gggagccactgggactactgggtccgggagggggaagggagggctgcgagcccgaacgcgcggcgagaaggccgaggggagggaggggagcgaggagcgggaggaggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 1147 - DNA, 867 bp, Homo sapiens
attgcgtagttccgaataccctcggccacacctggccttctccatgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctcc

SEQ ID NO: 1148 - DNA, 528 bp, Homo sapiens
ggtcgcgcggagattgctgggcggttcttgccggaagcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgca

SEQ ID NO: 1149 - DNA, 935 bp, Homo sapiens
tgcaaaagaggagcggctgggctgggggactccatgcgggggcgatggacagggcggcgctcctgggactggcccgcttgtgcgcgctgtgggcagccctgctcgtgctgttcccctacggagcccaaggaaactggatgtggttgggcattgcctccttcggggttccagagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctttggctacgagctgagcagcggctgtcgccaagttgatgtcagtagactgccgctgccacggagtttccggctcctgtgctgtgaaaacatgctggaaaaccatgtcttcttttgaaaagattggccatttgttgaaggataaatatgaaaacagtatccagatatcagacaaaacaaagaggaaaatgcgcaggagagaaaaagatcagaggaaaataccaatccataaggatgatctgctctatgttaataagtctcccaactactgtgtagaagataagaaactgggaatcccagggacacaaggcagagaatgcaaccgtacatcagagggtgcagatggctgcaacctcctctgctgtggccgaggttacaacacccatgtggtcaggcacgtggagaggtgtgagtgtaagttcatctggtgctgctatgtccgttgcaggaggtgtgaaagcatgactgatgtccacacttgcaagtaaccactccatccagccttgggcaagatgcctcagcaatatacaatggcattgcaaccagagaggtgcccatccctgtgcag

SEQ ID NO: 1150 - DNA, 4065 bp, Homo sapiens
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtga

SEQ ID NO: 1151 - DNA, 3678 bp, Homo sapiens
ctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1152 - DNA, 2290 bp, Homo sapiens
cgcggatcggcgtccgcagcgggcggctgctgaggtgagggccgggccagaggagaggcatacccactggggcgtaggtctgggactccccctgtccgccctggcgcgacctcaggactctccgtgtcccctccgtgacccccgcggcccgggccgctctttgcatcttgtcttgcccacagctggcctcggccaggtccgagggcctggatgcgaccttggggcagcccctactcttccgggcagcccacttccgcggccaccggtgcagggcatgccccggggccgtggaggtgagggaaagaggcgcgagtcgcgttttaactccgcccccgtcccccaaggccgcgcctcgcagcctgggctgcaaactttagcgtcctttaagttacagacgtgcgtggggctccgtgaggaggtgggcgaagagaaaggctctgagtaaataggcaaggcccggggtgagcaggggctggaatccgaaagtgggaggcggcggccccccaccctccatagtccttccgccctctgctagcaccgaagtttagcccaggacgggggccgtttaagggcccggccctccgccgccgcgcacgtgagcggcaccaggaagctggctgggcgcagccttccctgaggctcgctggcaccggccgcacgcgtccatcccgggcctctgagcggagggggagccgaggctagagggagggcgcagtctgcccaaggtcagcggcagcggcagtttctgggcgccaagtgtgattggagtactccaggaagaggggcgtgaccagagctctagcgaagagacctgacattgtaaagctaggtttggcttctgatttccacagggggtttgagaatgggacgagggtgctttagagggaccggtaggctttccctgaggacggtaatcagggcatgatggttggctcagtggttatttcctgggcaggggtgactgttctttcagctcccagcactggagcgctcggcccctgccgcactggatgccagcagttactaaaagtgagcctggcatttcagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccag

SEQ ID NO: 1153 - DNA, 1569 bp, Homo sapiens
agtgcatgacacagccagttaaatgcctctgtgagtttaccatctgaaaggaggcaaatcctgactttcgtttcttctctctactagctggcaatatagcaactatgaagagaaaagctactaataaaattaacccaacgcatagaagacttttttttctcttctaaaaacaactaagtaaagacttaaatttaaacacatcattttacaacctcatttcaaaatgaagacttttacctggaccctaggtgtgctattcttcctactagtggacactggacattgcagaggtggacaattcaaaattaaaaaaataaaccagagaagataccctcgtaccattaaagacatgatcaccaggatggaccttgaaaacctgaaggatgtgctctccaggcagaagcgggagatagatgttctgcaactggtggtggatgtagatggaaacattgtgaatgaggtaaagctgctgagaaaggaaagccgtaacatgaactctcgtgttactcaactctatatgcaattattacatgagattatccgtaagagggataattcacttgaactttcccaactggaaaacaaaatcctcaatgtcaccacagaaatgttgaagatggcaacaagatacagggaactagaggtgaaatacgcttccttgactgatcttgtcaataaccaatctgtgatgatcactttgttggaagaacagtgcttgaggatattttcccgacaagacacccatgtgtctcccccacttgtccaggtggtgccacaacatattcctaacagccaacagtatactcctggtctgctgggaggtaacgagattcagagggatccaggttatcccagagatttaatgccaccacctgatctggcaacttctcccaccaaaagccctttcaagataccaccggtaactttcatcaatgaaggaccattcaaagactgtcagcaagcaaaagaagctgggcattcggtcaatggaattttctgggccgaatacagaggcgggtcatactccttaagagcagttcagatgatgatcaagcctattgactgaagagagacactcgccaatttaaatgacacagaactttgtacttttcagctcttaaaaatgtaaatgttacatgtatattacttggcacaatttatttctacacagaaagtttttaaaatgaattttaccgtaactataaaagggaacctataaatgtagtttcatctgtcgtcaattactgcagaaaattatgtgtatccacaacctagttattttaaaaattatgttgactaaatacaaagtttgttttctaaaatgtaaatatttgccacaatgtaaagcaaatcttagctatattttaaatcataaataacatgttcaagatacttaacaatttatttaaaatctaagattgctctaacgtctagtgaaaaaaatatttttaaaatttcagccaaataatgcattttatttataaaaatacagacagaaaattagggagaaacctctagttttgccaatagaaaatgcttcttccattgaataaaagttatttcaaattg

SEQ ID NO: 1154 - DNA, 1073 bp, Homo sapiens
tttctgcacgtctgcaaaaggaagggagggaagcactccatcatctcactgggaagaacggcacgggcatacctgcagctactggggttccactgggcttgagggtcgatttttcaccttttgaaggacaagatgcattggaagatgttgctgcttctgctgttgtattacaatgctgaggcttctatgtgccacaggtggagcagggctgtgctcttccctgccgcccaccggccaaagaggtcctcatcactgccattgaacccagtcctgcagacctccctggaggaggtggagctgctctacgagttcctgctggccgaacttgagatcagccctgacctgcagatctccatcaaggacgaggagctggcctccttgcggaaggcctcagacttccgcaccgtctgcaacaacgtcatccccaagagcatcccagacatccgccggctcagcgccagcctctccagccaccctggcatcctcaagaaagaagactttgaaaggacagtgctgaccctggcctacacagcctaccgcacagccctgtcccacggccatcagaaggacatctgggcgcagtccctcgttagcctcttccaggccctgaggcacgacttgatgcgctcctcacagccgggagtacctccctgagagactggcccacaccaggacctcagagcagggaccagcacagtaatccagaaagtcttcattctctactccatttacagagaccagcaacaaaactcttaccgctgacacagagcagcagagatcaaacagtaaccccgatgctcttttctccttgtagtttcctggaagacacatctgattcatgccatcatgtgacctgggctggaagaaagggctggaatggtcattcaagacgcctccatgggcagaatggtttgcctatggcaggcagaattctgatatgcttcaacccagagcagtggccacacactcaagagtgagaacaggccgggcacagaggctcacgcctgtaatcccagcactttaggaggctgagacaggaggattatttgaggtcaggagttcaagaccagcct

SEQ ID NO: 1155 - DNA, 747 bp, Homo sapiens
aggcccttccgcaatcggagccctcacagaggccaaactgatataaatctgcttaggaggcctgattcacagacgctacaggatggagcggggcgcaggagccaagctgctgccgctgctgctgcttctgcgggcgactggtttcacatgtgcacagacagatggccggaacggctacacggcggtcatcgaagtgaccagcgggggtccctggggcgactgggcctggcctgagatgtgtcccgatggattcttcgccagcgggttctcgctcaaggtggagcctccccaaggcattcctggcgacgacactgcactgaatgggatcaggctgcactgcgcgcgcgggaacgtcctaggcaatacgcacgtgctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagttg

SEQ ID NO: 1156 - DNA, 709 bp, Homo sapiens; identical to SEQ ID NO: 820

SEQ ID NO: 1157 - DNA, 1996 bp, Homo sapiens
cctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1158 - DNA, 1313 bp, Homo sapiens
ccgggccagaggagaggcatacccactggggcgtagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccaggacccagaataaagccaatgatttacttgtttca

SEQ ID NO: 1159 - DNA, 873 bp, Homo sapiens
gggagccactgggactactgggtccgggagggggaagggagggctgcgagcccgaacgcgcggcgagaaggccgaggggagggaggggagcgaggagcgggaggaggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 1160 - DNA, 628 bp, Homo sapiens
aagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgatattatcaactcactggtaacaacagtattcatgctcatcgtatctgtgttggcactgataccagaaaccacaacattgacagttggtggagggttattttaactcagtataggagctagaggaagagatttccgaagtctgcaccccgcgcagagcactactgtaacttccaagggagcgctgggagcagcgggatcgggttttccggcacccgggcctgggtggcagggaagaatgtgccgggatccgcctca

SEQ ID NO: 1161 - DNA, 1287 bp, Homo sapiens
aaagctggacgaggcagccggacccgtctgcgctcgagcatggagacggagcgcctgggagggcacgtccggggcgctggagacgccaggcccgagtagcttctccatggagcctgcccagagcggtcccttctcgcaggattcgccccaagtcctgtgcggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttgagttttcaaagtaagaaaattacaaaacaagctaacagaggtttgtcttcttcctagagtgggcaagatctttagaaccacaactcaggtttgacttggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactgggaaaattgtagatcatggcaatgggacatttagtgtttatttcaggcataattcaactggtcaagggaatgtatctgtcagcttggtaccccctacaaaaatcgtggaatttgacttggcacaacaaaccgtgattgatgccaaagattccaagtcttttaattgtcgcattgaatatgaaaaggttgacaaggctaccaagaacacactctgcaactatgacccttcaaaaacctgttaccaggagcaaacccaaagtcatgtatcctggctctgctccaagccctttaaggtgatctgtatttacatttccttttatagtacagattataaactggtacagaaagtgtgccctgactacaactaccacagtgacacaccttactttccctcgggatgaaggtgaacatgggggtgagactgaagcctgaggaattaaaggtcatatgacagggctgttacctcaaagaagaaggtcacatctgttgcctggaatgtgtct

SEQ ID NO: 1162 - DNA, 610 bp, Homo sapiens
ggaggtgaggcggaactctgaggacatagacctggaggcttctgctgctgctgcaggccaaggaatggaaaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggat

SEQ ID NO: 1163 - DNA, 3523 bp, Homo sapiens
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 1164 - DNA, 2245 bp, Homo sapiens
ggccccggagctccacccatgtccccttggtgctgccgcttcttgtacttctgctgctggccccggctaggcaggccgccgcccagcgctgcccacaggcctgcatctgtgacaactccaggcgacacgttgcctgccggtaccagaacctcactgaggtgccagacgccatccctgagctgacccagcggctggacctgcagggcaatttgctgaaggtgatccccgcagccgccttccagggcgtgcctcacctcacacacctggacctgcgccactgcgaggtggagctggtggccgagggcgccttccgtggcctgggccgcctgctcctgctcaacctggcctccaaccacctgcgtgagctgccccaggaggcgctggacgggctgggctcgttgcggcggctggagctggaggggaacgcactggaggagctgcggccggggacgttcggggcactgggtgcgctggccacgctaaacctggcccacaacgccctggtttacctgcccgccatggccttccaggggctactgcgcgtccgctggctgcggctgtcgcacaacgcgctcagcgtgctggcccccgaggccctggctggcctgcccgccctgagacggctcagcctacaccacaacgagctccaggctctgcccgggcctgtcttgtcccaggcccgcggcctggcccgtctggagctgggccacaacccgctcacctacgcgggcgaggaggacgggctggcgctgcccggcctgcgggagctgctgctggacggcggggccctgcaggccctgggtcccagggccttcgcacactgtccgcgcctgcacaccctcgacctccgcgggaaccagctagacaccctgcccccgctgcagggcccgggccagctgcgccggctgcggctgcaggggaatccgctgtggtgcggctgccaggcgcggcccctactcgagtggctggcgcgggcgcgcgtgcgctcggacggcgcgtgccaggggccgcggcgcctgcggggcgaggctctggacgccctgcggccctgggacctgcgctgccctggggacgcggcgcaggaagaggaagagctggaagagcgggctgtggccgggccccgcgcccctccgcgcggccctccgcgcggccccggggaggagcgggcagtcgcgccttgccctcgcgcctgcgtgtgcgtccccgagtcccggcacagcagctgcgagggctgcggcctgcaggcggtgccccgcggcttccccagcgacacccagctcctggacctgaggcggaaccacttcccctcggtgccccgagcggccttccccggcctgggccacctggtgtcgctgcacctgcagcactgcggcatcgcggagctggaagcgggcgccctggccgggctgggccgcctgatctacctgtacctctccgacaaccagctcgcaggcctcagcgctgctgcccttgaaggggctccccgcctcggctacctgtacctagaacgcaaccgtttcctgcaggtgccaggggctgccctgcgcgccctgcccagcctcttctccctgcacctgcaggacaacgctgtggaccgcctggcacctggggacctggggagaacacgggccttgcgctgggtctacctgagtggaaaccgcatcaccgaagtgtcccttggggcgctgggcccagctcgggagctggagaagctgcacctggacaggaatcagctgcgagaggtgcccactggggccttggaggggctgcctgccctcctggagctgcagctctcgggcaacccactcagggccttgcgtgacggagccttccagcctgtgggcaggtcgctgcagcacctcttcctgaacagcagtggcctggagcagatttgtcctggggccttttcaggcctggggcccgggctccagagcctgcacctgcagaagaaccagcttcgggccctgcctgccctgcccagtgccaggagaacccccatcaaaggaagacagtgtggagcagataaggtggggaaggagaagggtcgtctctgagcacggagcaggctggtcctgccttgacccagcccggtggctcttactctcgccaggaacaggctccgacgagatcttcctggcaccctgagggtcgtcctccagcaggggcttcttggacccctgtctgaggggtcgcgtcttagtgggcgggattcttttccctttgaataaaaatggattcaaaccca

SEQ ID NO: 1165 - DNA, 2446 bp, Homo sapiens
acttggctctgcctccgctgactctagcgccatggcccggcacctgctcctcccccttgtgatgcttgtcatcagtcccatcccaggagccttccaggactcagctctcagtcctacccaggaagaacctgaagatctggactgcgggcgccctgagccctcggcccgcatcgtggggggctcaaacgcgcagccgggcacctggccttggcaagtgagcctgcaccatggaggtggccacatctgcgggggctccctcatcgccccctcctgggtcctctccgctgctcactgtttcatgacgaatgggacgctggagcccgcggccgagtggtcggtactgctgggcgtgcactcccaggacgggcccctggacggcgcgcacacccgcgcagtggccgccatcgtggtgccggccaactacagccaagtggagctgggcgccgacctggccctgctgcgcctggcctcacccgccagcctgggccccgccgtgtggcctgtctgcctgccccgcgcctcacaccgcttcgtgcacggcaccgcctgctgggccaccggctggggagacgtccaggaggcagatcctctgcctctcccctgggtgctacaggaagtggagctaaggctgctgggcgaggccacctgtcaatgtctctacagccagcccggtcccttcaacctcactctccagatattgccagggatgctgtgtgctggctacccagagggccgcagggacacctgccagggtgactctggggggcccctggtctgtgaggaaggcggccgctggttccaggcaggaatcaccagctttggctttggctgtggacggagaaaccgccctggagttttcactgctgtggctacctatgaggcatggatacgggagcaggtgatgggttcagagcctgggcctgcctttcccacccagccccagaagacccagtcagatccccaggagcccagggaggagaactgcaccattgccctgcctgagtgcgggaaggccccgcggccaggggcctggccctgggaggcccaggtgatggtgccaggatccagaccctgccatggggcgctggtgtctgaaagctgggtcttggcacctgccagctgctttctggacccgaacagctccgacagcccaccccgcgacctcgacgcctggcgcgtgctgctgccctcgcgcccgcgcgcggagcgggtggcgcgcctggtgcagcacgagaacgcttcgtgggacaacgcctcggacctggcgctgctgcagctgcgcacgcccgtgaacctgagcgcggcttcgcggcccgtgtgcctaccccacccggaacactacttcctgcccgggagccgctgccgcctggcccgctggggccgcggggaacccgcgcttggcccaggcgcgctgctggaggcggagctgttaggcggctggtggtgccactgcctgtacggccgccagggggcggcagtaccgctgcccggagacccgccgcacgcgctctgccctgcctaccaggaaaaggaggaggtgggcagctgctggaatgactcgcgttggagccttttgtgccaggaggaggggacctggtttctggctggaatcagagactttcccagtggctgtctacgtccccgagccttcttccctctgcagactcatggcccatggatcagccatgtgactcggggagcctacctggaggaccagctagcctgggattggggccctgatggggaggagactgagacacagacttgtcccccacacacagagcatggtgcctgtggcctgcggctggaggctgctccagtgggggtcctgtggccctggctggcagaggtgcatgtggctggtgatcgagtctgcactgggatcctcctggccccaggctgggtcctggcagccactcactgtgtcctcaggccaggctctacaacagtgccttacattgaagtgtatctgggccgggcaggggccagctccctcccacagggccaccagatgacctcagcaccgcccctcctgtgccagatgacggaagggtcctggatcctcgtgggcatggctgttcaagggagccgggagctgtttgctgccattggtcctgaagaggcctggatctcccagacagtgggagaggccaacttcctgccccccagtggctccccacactggcccactggaggcagcaatctctgccccccagaactggccaaggcctcgggatccccgcatgcagtctacttcctgctcctgctgactctcctgatccagagctgaggggctagggtcccagcaccacttcccccttctccaccctctacttcccgcccagtggggctggaatgtggcccagccggctggaacctcaagggccccacccaccgagattgcagcggctctggctaattgggcctcagtgcccgggctattttg

SEQ ID NO: 1166 - DNA, 730 bp, Homo sapiens
agtcatgcgttttatggcaggccctgcagggagccagagtctgggtcccctgtgcttccacagcagcccccaagccctctacacggtcctcttaatagtgctggtcatgatgagcttggtgtttggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtt

SEQ ID NO: 1167 - DNA, 1257 bp, Homo sapiens
gcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcc

SEQ ID NO: 1168 - DNA, 2994 bp, Homo sapiens
aaaaatgcataaagagccaagtgcttatattctggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggccataagatgttttattgaaagaaactttcaatatcaagtaatccaaccaaccttctaagataagccttttccttcaacacaaagaagtgcattttgccaaatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtcc

SEQ ID NO: 1169 - DNA, 873 bp, Homo sapiens; identical to SEQ ID NO: 1159

SEQ ID NO: 1170 - DNA, 1873 bp, Homo sapiens
gtccctagagacagcctggaaagattgggtgccagctgcagagaggagagcaaggcgaccaaacgcaggctgtggctgcctgcagcccatcctgcccccagcacctagagtcatctttagaaatgcaagcctgatcgtggaatccaccttcctaacacccttcagtgccctcctcttcgttacacccttactatacaaacgatagtccatggaccagcagcatcaacataaccagggagcttgttagaaatgtagaatctggtccatcccaaacctgacgaagcagaagctgcattttgccaagatcccagggaatttgtgtgcccgttatggtttgcgaagtgcttcccaagagaacatacggcaagccagagggatctttgcagatcttgctcctttcattctctggcctcatcttgtcgctctcctccatccgtgcccacatccccactgtactggaccgcttgcagctccttgaatgcagcatagtcttgttttcttttttgcagtgattctacatctttcccatcttctccacctggatgcctccatccatcctttcagacttcccttctctagcaaacctttcttgctaattcccatgtctaacacaacacttccccatactgcatggccattatcctttctgcatcagactgtgagcaccttgaaggcagtggcagtgactcattcattgtggcatctgcagattccagtggactgccaggcatgcaatagaaaatcaaaaaagatttactgctaaataatcctcaactccagtggcagctccatgtgccatttctcttccgctctggcctcggctcttcctgtgcctacctggggcttggctttcacctaggtgtctgcatggaagggagagcgacctggaggaccatcgccaatccatcaatagcctcccggttgagatgacttcagctctgatttggaagagctatgatattgtttataggagtgaattaatatgtgtaaaggttacaaagtaaacagttaaattaaattaattgtgctggagcaggtcaaacaggcttctgagagatgaacatacacatctctattaactccacattcagtgagtgtgggtaacttgaaattggctgggtcaccatttacatcatagaaattggcaaatagtacaaattagggctccctcacccctactcgggcatagagctggtacactagcacacctctggttatacatgcatgcgtgtgccaccagaacaaaacacctaacagcaggcacgttgcctctgttgcccaccattacagctcccgcacggagcagacagactcatggcaggaattgaatgcatgtttgtcgagtggaagcatgaacaaatccacaaaatgcccaagatgaggcaaagaaggacattggctcaaatgttaaacataagttaggagctgagataatgcccagaggaaaaatgttctgtaattctaagtaaaacccatctctaaggcaggatgctgcttatgagggctccacagacagatgggggaggcctgggtcctgcccttggaaagagtctgacagctcgacttctggaaacagccatctgcacaggtcaacatcttcttagctgacagggagcagatttgcagaccacatcacatttgaaattccagaagaaacttcttggagtctgctcttgtgcaaatgagcctagaaagcccgttaactttgggtggaggcttccactgtttggctatcccaagtgggcccaaagctaaggaaaacccaccagccctttgcttcctgcttcctctatttgtttgccccaggaaatcagaggtgatgacatgatttggcttgggcacgacaggaataaacgatatttaagagacgtca

SEQ ID NO: 1171 - DNA, 812 bp, Homo sapiens
gttcaggaagtcatcaccttctcttgtcagggcatttctggggaccaacagctggccgaggctcagggatagagacggctgctccagctaaaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccc

SEQ ID NO: 1172 - DNA, 3588 bp, Homo sapiens
agcctagagctggggcgaggtgggcatcaccactaggaatttctcctgaggcagtgagaagaggggacaaaggtttcaggactctctagctccttctgctctccccagtggacccctctgtctggcactgccatgccacttagctggggtcagcgtgggcctggggtgtggaatgtcccaccagggtatgacgggctgtagcttgcctggcaggcctgttggggctttcccagagcacagctcctggaaggaggggctgtgggctgccaggtgaggtgacttgggaagccttggccccacccccaggctggccccacccccagtccagcgtctcctgggcctagattccccagctgctgttctctggagggagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactg

SEQ ID NO: 1173 - DNA, 1624 bp, Homo sapiens
ggaaactgttttccaatttgattcttattggaaagcataacaaccagccagggcctgtgctgctggagcgggcagttatgtgcagggagacagctggttacggctggctcctggcctcgacggagcttctcagcctcttggagcctctgtcccctcagctgctgaaggaacacatctcctgcacttctcaagttgctgccggtgcgaaggtgactccagattctgcagtttgggctccgtagctgctcagcaaatgtcagcaggtccagaagcaaggctcctcagctgcagagtgaatgcaaatgccccttctgctctcctgcagctgcggcaggtggaagagctgtcgggggtgggaagggggcttggagggataaggatgggctggggagggctcccaaggcagtggacactgtgggctctggggactgcatggctgtggagggggcatgtgctgttgggctcccagcctcttggggtcctctctgtgccaagatagagcctgttaccctccctgagcaggtgtgagcagacacctgtcccctgccctgcatgggaagtgaacgatccactaagtggggaggtcagggtcagatccccggccttcccatgcaggatgactgctcaggcccaggacagtgggtggtcaacagaaaccccatccctgcccatagagggtgcttcccagttcacagtgacacagcctggcctgctcctcttccagccacccaaggcaagacacagagcaggaggctgaggctggtgtgagggaaagggggatgcagcaaggggatacctcaaccttgcccgagctacagacaggtgaggacttctccctcacctggtgttttccactgcattctgaagagcaggtgacacccaccccagggtggatccaggatggatctctgggtttcctgccatctacaatgaccctcctcatttcccctggctagctgccccctaggatggagaatgcatcatggtcactgacacttggcgcccttttccagcctcaatggcctggcagagccagtggggacacagcaataatgtgggtggcagtaataacagcagctgaaccacctgagcaccatcctgacgaggcatagcctgagctctgtgaacagtgaagtccatctggtctctcagtggcctgagagtgactctaactattatcctcattctctgaaggaggaaaacaaggcaaggggatttaaataatttttaaaggtcagataccttcacaaaggctgaagtgggagtcagatgatagtgtctgggtggagaccccatactcttaccctcaactctgagccatctgctatacaacatctatttgctgagtggaaggtgtgtagcctgaaccatgctcacttctggtccagagctctttcctcagggccctgggacattcacgtttagtgtacagtggtatatgtatgctgaattcctacattaggccagccacatagtcagcactgattgctaaaagaataactgaataaggataaatgcttgaggggatggataccccattctccatgatgcgattatttcacattccctgcttgtatcaaaacatctcatgtaccccataaatatatacacctactatgtactc

SEQ ID NO: 1174 - DNA, 2415 bp, Homo sapiens
acagttcaggaaacttaaaaggatggcatatggaagttgagtgaaggagaaagagagggaagtagaaaagaggagaaaaatgttaagcaaaaaaggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctctttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtccagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccatggacctgggccagctctgtgagggctttacccttccacccgaaggacatcatgggggcattcagccactcagaaatgcagatgattaaccaatattgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgctt

SEQ ID NO: 1175 - DNA, 799 bp, Homo sapiens
ctgccggtgagcgccagcttcagggtcccacccccccatgcctggctcttggctgaacatttcttcccagcgcttccagcagccagaggcaggcgcccaagctcgctggctgttgctgagggcctgtagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacc

SEQ ID NO: 1176 - DNA, 531 bp, Homo sapiens
tagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacggctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgagg

SEQ ID NO: 1177 - DNA, 3832 bp, Homo sapiens; identical to SEQ ID NO: 826

SEQ ID NO: 1178 - DNA, 1095 bp, Homo sapiens
gaccttccgcgcggacggtgggcaggcgacggcggcgtgtggatggaggccttcgcccttggcccagcgcggcggggcaggcggcggacccgggccgccggctccctgctctctcgggccgccatcctcctctttatctccgccttcctggtgcgggtgccctcatcagttggacacttggttcgattaccaagagcttttcgcttgaccaaagattcagtgaaaatagtgggatcaacaagttttccagtgaaagcgtatgtcatgctccatcaaaagagtccacacgtgttatgtgtaacgcaacaactgcgaaatgctgaactgatagacccatcattccaatggtatgggcctaaaggaaaagttgtttcagaaaaccgcactgcacaaataacatccacaggaagccttgtattccaaaattttgaggagagtatgagtggaatttatacatgtttcctcgaatataaacctactgtggaagaaattgttaaacgtcttcaactaaaatatgctatatatgcttatcgtgagcctcattattattatcagttcacagctcgatatcatgcagctccctgcaatagcatttataatatttcttttgagaagaaacttcttcagattttaagcaaactgcttcttgacctttcatgtgaaatttccttacttaagtctgaatgccatcgcgttaaaatgcaaagagctggtttgcaaaatgaattgttctttgcattttcagtttcatctctagacactgaaaaaggacccaagcgatgtacagaccataactgtgaaccttacaaaagactttttaaggctaaaaatctcatagagagattttttaatcaacaagtagaaattcttggcagacgtgcagaacaattacctcaaatatactatattgaaggtactctccaaatggtttggattaatcgctgctttccaggatatggaatgaatgtccagcaacatccaaaatgtcctgagtgctgtgtgatctgcagccctggatcatataacccccgtgatggaattcattgccttcaatgcaatagcagcctggtgtatggagcaaaaacgtgcttataa

SEQ ID NO: 1179 - DNA, 4326 bp, Homo sapiens
gctggccctggtactgtgcactgtggacagccgcccgcccgcccagctggccctcagccacgccggtcgcctcttggcctcctcgacagcagcctctgtccccaacaccctgcgcctggagctgcgagggccacagcccagggatgagggtttctacagctgctctgcccgcagccctctgggccaggccaacacgtccctggagctgcggctggagggtgtgcgggtgatcctggctccggaggctgccgtgcctgaaggtgcccccatcacagtgacctgtgcggaccctgctgcccacgcacccacactctatacttggtaccacaacggtcgttggctgcaggagggtccagctgcctcactctcattcctggtggccacgcgggctcatgcaggcgcctactcttgccaggcccaggatgcccagggcacccgcagctcccgtcctgctgccctgcaagtcctctatgcccctcaggacgctgtcctgtcctccttccgggactccagggccagatccatggctgtgatacagtgcactgtggacagtgagccacctgctgagctggccctatctcatgatggcaaggtgctggccacgagcagcggggtccacagcttggcatcagggacaggccatgtccaggtggcccgaaacgccctacggctgcaggtgcaagatgtgcctgcaggtgatgacacctatgtttgcacagcccaaaacttgctgggctcaatcagcaccatcgggcggttgcaggtagaaggtgcacgcgtggtggcagagcctggcctggacgtgcctgagggcgctgccctgaacctcagctgccgcctcctgggtggccctgggcctgtgggcaactccacctttgcatggttctggaatgaccggcggctgcacgcggagcctgtgcccactctcgccttcacccacgtggctcgtgctcaagctgggatgtaccactgcctggctgagctccccactggggctgctgcctctgctccagtcatgctccgtgtgctctaccctcccaagacgcccaccatgatggtcttcgtggagcctgagggtggcctccggggcatcctggattgccgagtggacagcgagccgctcgccagcctgactctccaccttggcagtcgactggtggcctccagtcagccccagggtgctcctgcagagccacacatccatgtcctggcttcccccaatgccctgagggtggacatcgaggcgctgaggcccagcgaccaaggggaatacatctgttctgcctcaaatgtcctgggctctgcctctacctccacctactttggggtcagaggtgaggggagggggctccatctcccaggccactctgcacaaaagcccagctcttaggcccaaaggcttccttccctgtatccctcctgctgcagcatgatttgcctgtcgactctaaactgattgctcggggcacccttgtgtggagagcttcagcgataaagcaaaagttagaaggtgtcatcttgggtgggtccccttggaaggaagcactgggggcctgcagctgtggctgctctgagtcccgctctgtgttccagccctgcaccgcctgcatcagttccagcagctgctctgggtcctgggactgctggtgggcctcctgctcctgctgttgggcctgggggcctgctacacctggaggtgggtctggagctgggagtgggccagaagattggggtaaggcagcccacctcgtcttctccccaaattcccccaggtcctttaggacctcctattaagttcacaggctgcctacttcccagactgcccctccaaattggaaatcccttctagaattgtccctaaatcctccttgctgtagtttccttctttcctcctctctgccctggctgtgctaaagcaagggctagggaggaagacagaggaagcacccactctccatgaggttcccacgctcttgtggtctggagccagcctgtggggagcgggagaggaatgggggcaggaggtggggaggggagaggctctctgagtccactccgggccttgcagaaggaggcgtgtttgtaagcagagcatgggcgagaattcggtggagatggcttttcagaaagagaccacgcaggtatccattcaacacacacgggcagatataatacccagctaacccacagtgccaactggcatctggagactgctgtcatttagaggatggtgcctgggaccaaggggaggttggggagagtgtgcagggaaccaggagcccctcaggagataggagagccctgttctgctcggggcagagggaatccctgtgtcagctggcggctggcttagaggactaggggagactttctggacttggcagcatcccctccatttccaagacacgtatgttctgactcccccacctttgttctgaggcctcttccccactcccaagcctgcccgtcacctgggcagaagtgaaagtcagtttctcctcccctgtggtgtgtcccttctgcagctgattcacctggtaggccagggctccaagtcacacttccagccatgcacactcccaccaatcctcttgggaccccacctgaggctgggggcctgggggcctgccctggctcccagaggcctcctgtgaccagggttttctctgtgggaagctcattgatcctgatgcagccacatgtgagacctcaacctgtgccccacccctgggctgaccagtggtgttgcctgccctccggaggagaaagtggccagaatctgtgatgactccagcctatgaatgtgaatgaggcagtgttgagtcctgcccgcctctacgaaaacagctctgtgacatctgactttttatgacctggccccaagcctcttgcccccccaaaaatgggtggtgagaggtctgcccaggagggtgttgaccctggaggacactgaagagcactgagctgatctcgctctctcttctctggatctcctcccttctctccatttctccctcaaaggaagccctgccctttcacatccttctcctcgaaagtcaccctggactttggttggattgcagcatcctgcatcctcagaggctcaccaaggcattctgtattcaacagagtatcagtcagcctgctctaacaagagaccaaatacagtgacttcaacatgatagaattttatttttctctcccacgctagtctggctgttacgatggtttatgatgttggggctcaggatccttctatcttccttttctctatccctaaaatgatgcctttgattgtgaggctcaccatggccccgctttgtccacatgccctccagccagaagaaggaagagtggaggtagaagcacacccatgcccatggtggacgcaactcagaagctgcacaggacttttccactcacttcccattggctggagtattgtcacatggctactgcaagctacaagggagactgggaaatgtagtttttattttgagtccagaggacatttggaattggacttccaaaggactcccaactgtgagctcatccctgagacttttgacattgttgggaatgccaccagcaggccatgttttgtctcagtgcccatctactgagggccagggtgtgcccctggccattctggttgtgggcttcctggaagaggtgatcactctcacactaagactgaggaaataaaaaaggtttggtgttttcctagggagagagcatgccaggcagtggagttgcctaagcagacatccttgtgccagatttggcccctgaaagaagagatgccctcattcccaccaccaccccccctacccccagggactgggtactaccttactggcccttacaagagtggagggcagacacagatgttgtcagcatccttattcctgctccagatgcatctctgttcatgactgtgtgagctcctgtccttttcctggagaccctgtgtcgggctgttaaagagaatgagttaccaagaaggaatgacgtgcccctgcgaatcagggaccaacaggagagagctcttgagtgggctagtgactccccctgcagcctggtggagatggtgtgaggagcgaagagccctctgctctaggatttgggttgaaaaacagagagagaagtggggagttgccacaggagctaacacgctgggaggcagttgggggcgggtgaactttgtgtagccgaggccgcaccctccctcattccaggctcattcattttcatgctccattgccagactcttgctgggagcccgtccagaatgtcctcccaataaaactccatcctatgacgcaa

SEQ ID NO: 1180 - DNA, 1496 bp, Homo sapiens
ggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcc

SEQ ID NO: 1181 - DNA, 4298 bp, Homo sapiens
gcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 1182 - DNA, 577 bp, Homo sapiens
gggacgcggactcgggagtgcgcacattcgcagcccgggcagccctgctgcgcaccgggcctcgcgccccgcgccccgcgccccgcgccccgcgccccgcaccgctttgctgaattggcctgggaatgctgcccctggaaggcattggacagaacagggacagtcctgttgcgtgaggggcatgggcctccaggatcatgtggtatgtcagcaccaggggcgtagccccacgggtcaactttgagggggccctcttctctggctatgcacctgacgggggcctctttatgcctgaagagctcccacagttggacagagggaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtactt

SEQ ID NO: 1183 - DNA, 356 bp, Homo sapiens
gacccacaagaacagagtcgagcaaggaaacgtgcaacagtgatacaaaagtctggctttgctaaagtcacacatccagtaagtggccgaagcagatcttcagacccacagtttggctgccaaaggaccacagtgagtatttctaatgctgaaacaagagggtgcagctctgcagcccagacggctgggcctcagggaaccctcccagcctccatgccgcctttcctgatcaccctcttcctctttcactcttgctgcctccgagcaaatggccacctccgtgaaggaatgacattgctgaagactgagtttgcacttcacctctaccagagtgtggccgcgtgtagaaatgagac

SEQ ID NO: 1184 - DNA, 922 bp, Homo sapiens; identical to SEQ ID NO: 819

SEQ ID NO: 1185 - DNA, 462 bp, Homo sapiens
atgactatccacatcctcatcctgctgttgctcctcgccttctccgcccaaggggacctggacactgcagccaggcgaggccagcaccaggtcccccagcaccgcgggcacgtctgctacctgggcgtatgccggacccaccgcctggcggagatcatatactggattcgctgtctccaccaaggagccctcggggaaggccagccacgagccccaggacccctacagctatgggcgccgccggtggcgcgaggcggaagcccggctcggttcccaggattccggcctgcagcgagggggctagcgcagtgcccagctcgctgggtgacctcgggcacggctcgtcccctcctcggcttcagtttgcctatctgtatgttggagcttctactccacatttcttctcccctaactccagcccctgaaaccgtcttccccagtccctccccgggctgcgactag

SEQ ID NO: 1186 - DNA, 553 bp, Homo sapiens
gttctcccattgtcagccagtctatttccagattgtttgaacttctctggccgcacaatacaggaaggaagactaaagcagcaaagggacctacagcgtctgcagcatgggctggttaactaggattgtctgtcttttctggggagtattacttacagcaagagcaaactatcagaatgggaagaacaatgtgccaaggctgaaattatcctacaaagaaatgttggaatccaacaatgtgatcactttcaatggcttggccaacagctccagttatcataccttccttttggatgaggaacggagtaggctgtatgttggagcaaaggatcacatattttcattcgacctggttaatatcaaggattttcaaaagattgtgtggccagtatcttacaccagaagagatgaatgcaagtgggctggaaaagacatcctgaaagaatgtgctaatttcatcaaggtacttaaggcatataatcagactcacttgtacgcctgtggaacgggggcttttcatccaatttgcacctacattgaaattggacatcat

SEQ ID NO: 1187 - DNA, 668 bp, Homo sapiens
ttgctgggcggttcttgccggaagcggagagcggctgatcgcagtccggaggcagatatcctccctttcctcctcggctgctgctcttactttgacaagccaggctaacattgaagcaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgt

SEQ ID NO: 1188 - DNA, 799 bp, Homo sapiens
ctgccggtgagcgccagcttcagggtcccacccccccatgcctggctcttggctgaacatttcttcccagcgcttccagcagccagaggcaggcgcccaagctcgctggctgttgctgagggcctgtagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacc

SEQ ID NO: 1189 - DNA, 800 bp, Homo sapiens
actgccggtgagcgccagcttcagggtcccacccccccatgcctggctcttggctgaacatttcttcccagcgcttccagcagccagaggcaggcgcccaagctcgctggctgttgctgagggcctgtagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacc

SEQ ID NO: 1190 - DNA, 3845 bp, Homo sapiens; identical to SEQ ID NO: 1077

SEQ ID NO: 1191 - DNA, 2158 bp, Homo sapiens
ggtgcgtcccccaacctgatgctagcccctttcctgttacttctcacccacagcaggagccccttgtctttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgc

SEQ ID NO: 1192 - DNA, 1324 bp, Homo sapiens
taagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcagg

SEQ ID NO: 1193 - DNA, 824 bp, Homo sapiens
tctccggggcgtggcgaagaggggcggagtcacgagcggggcggtgagacttcctgcccagtcgcgggccagcctagcgcttcagccggcggctcatttccggtgggggcgccgcgcccagtgagggcccggaagtgggtcgcgcggagattgctgggcggttcttgccggaagcggagagcggctgatcgcagtccggagcaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccg

SEQ ID NO: 1194 - DNA, 1606 bp, Homo sapiens
gagaccgacccgccacccgccgtagcccgcgcgcccctggcactcaatccccgccatgtgggggctcctgctcgccctggccgccttcgcgccggccgtcggcccggcccagtctcagaccccaatgacctattccttgaggcccctgcgtcgggatcctctgaccctctagactttcagcatcacaattacaaggccatgaggaagctgatgaagcaggtacaagagcaatgccccaacatcacccgcatctacagcattgggaagagctaccagggcctgaagctgtatgtgatggaaatgtcggacaagcctggggagcatgagctgggggagcctgaggtgcgctacgtggctggcatgcatgggaacgaggccctggggcgggagttgcttctgctcctgatgcagttcctgtgccatgagttcctgcgagggaacccacgggtgacccggctgctctctgagatgcgcattcacctgctgccctccatgaaccctgatggctatgagatcgcctaccaccggggttcagagctggtgggctgggccgagggccgctggaacaaccagagcatcgatcttaaccataattttgctgacctcaacacaccactgtgggaagcacaggacgatgggaaggtgccccacatcgtccccaaccatcacctgccattgcccacttactacaccctgcccaatgccaccgtggctcctgaaacgcgggcagtaatcaagtggatgaagcggatcccctttgtgctaagtgccaacctccacgggggtgagctcgtggtgtcctacccattcgacatgactcgcaccccgtgggctgcccgcgagctcacgcccacaccagatgatgctgtgtttcgctggctcagcactgtctatgctggcagtaatctggccatgcaggacaccagccgccgaccctgccacagccaggacttctccgtgcacggcaacatcatcaacggggctgactggcacacggtccccgggagcatgaatgacttcagctacctacacaccaactgctttgaggtcactgtggagctgtcctgtgacaagttccctcacgagaatgaattgccccaggagtgggagaacaacaaagacgccctcctcacctacctggagcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattgatacctgcggtttaagagccctagggcaggctggacctgtcaagacgggaaggggaagagtagagagggagggacaaagtgaggaaaaggtgctcattaaagctaccgggcacctt

SEQ ID NO: 1195 - DNA, 8152 bp, Homo sapiens
aggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacgatattataaagctgtggaagttttttccactagtttcaggtgtttttttttttgttgttgttgttgttattttgaactacttaccaaaattagaagttaaaatctaattagaaattaataagatactaaaattcatgacagttttttgtttgtttgtttgtttgttttttggtatttcttgatttgggcataaaaggcacacccattctctcatgcttggaagaagctgctattcctactggctatctaagaagaatggaattattaattttatttgacttattaattttaaacgagtttaatttgggatcatttagtaagtactcttttctttttgagctgtgatagattatagtctagtttaagttgctcctaagtagacagatgaagaaactagggaggctttagagaggaagacagatgcttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtagctcaagcctgtaatcccagcactttgggaggccaggcaggaggattgcttgaggccaggagtttgagaccagcctgggcaacatagtaagacctcatctctacaaaaaataaaaaattatccaggtgtgggccgacagtcccagctactagggaggctaaggcagggtgattgattgagcccagtagtttgaggctgcagtgagttatgattgcgccactacactcccacttgggcaacagacaagagatcttatctctaaaaaatttttgttaaataataaaagaattaaggccagggatgttggctcacatctgtaatcccagcagggattatagtctcgggaggctgaggtgggcggattgcttgagcccggaaggtcaagaccagcctgggtgccatggtgaaaccccatctctacaaaaaaatacaaaaactagctgggtgtggtggcaccacctgtagtccccgctacttaggaggctgaggtgggaggattgcttgagcccaggaggcagaaggttgcagaggttgcagtgagccttgattgtgccactgtactccagtctgggcaacagggcaagaccctgtctctaaaaaaaaaaaaaaaaaaaaaagagggaccatgatgcctctgggatttatgaaaccaacctttgtggcgagtgctcagtgattctgatgcaatggtggtattccacactgtgagaaacactaagagaagaggtaagatagaatgagggaataaacatggcttgtttattattttgggggatttaccaataactggtttaattctgttcatgatccaatagtattggtgatattagctccattttatagatgaggaactcatgtttagatctgaaataaggtatgtgagagtccatatctcttttcagctaaacttgtgagactttcgtaaagaagcgtttgtatttatttatttgtttttgagacagggtcttgctcttttgcccaggctggagtgcagtggcatgatatggctcactgcagccttgacttcctgggctcaagggatccttctgcctcagcctcctgagtagctgggactacaggtatgtaccaccatgcccagctaatttttgtatctttttgtagagactacattttgccatgttgtccaggctggtcttaaactcctgagctcaagcatctgcccacctcagcttcccaaagtgctgggattacaggtgtgagccactgtgcccagctgagagtttttcttgtcgtgaaagaacttgacatttcctcaaggatttataaaggaggctgaggagtaattttcccaggagaattttaaaaagaaagcgggcattgctcctccagtggtttggaatgatgccacttgattgtgcaaatgatttcttatgatcttgtctggttttctgttattttttgatttggtgacatagctctcaaagatttggtgacacagcttcttgagtcactttcatctctcttaaaaaaattttttttttaacaacttttaagttcaggggtacatgtgccagtttgtttcataggtaaacttacgtcatgggggtttgttgtatagatgatttcatcacccaggtgttaagcctagtacccattagtaatttttcctgatcctctccctcctcctaccctccaccctccaatagaccccagtgtgtgttgttgccctttatgtgtccatgtgttctcatcatttagctctcacttatcagtgagaacaactttcatcccacatctaatttgtctttcttcactctggtgtggaaattttgatagagattccaatatcacttaaacgtttcccagaatatttagatagaataatttagtttcttctgaaaagtttattttaggctagtgccacatggttgtgaatattagcatggtagccaaataatagtttgtttaaatgtatatttcccaatataaatataaggggcatcataatttttaaaaactataaaatctagaagaaaaatctatggataaaatccataattctatcatctgaatgcaatgaacattagcatttaggtatattttcttgcaggttttttaaccatatacttatagagaatatgtaatttgggtctgtgttttttacatataaatatttttctatgttaaatagtcttcataagttaattataaagatctgcttaatagttctgctactgcagttttcattattagataagttggtcattatagttggacatttaggtttacaatattaaagcagtggtttatatcaatttcagtggtttaaaatatgaatttctattttggaatgaaagtattaatttaatgtagtgaatctcatattccagaactgagatgattgatttgatgctatttgtgacagacagaacccataataaagcctttctatgcaagttacattttatagaattatcctactaaaagtaacctttcttcagcgaatgcaaaacagacctttggtgttccagtatgattcattttgccattctgaacaactatcattttaattaagaccatttaactgacacttcctggattcagttattaagtttcagattgaaacttgatccagtttaataactgaatccagtttcacatttatcaatctgaaaacttagtttgcagattggtaaatcagggtacttgacaagaataaatatggtacgcctttatatattcatgtgttacatgccagaaatgagtctgtttctggaccctgttcaaggaaatagtgatgactgagagaggtacagggaaataaacacccaagggaaacaacagaaataagcctccccaactttctaaaaaactgctcagcattatctctgtggattctgggtaaattcagctttttaacatcagctagtcactaatgccagaaattccacttcaagtgtatttattttcttgtgttaagcattattctacctggtttatgtctacaatgtagtattagtgtacttaggattcttgacacctcagtgtgcaataaataaaattttgaagttgttgtttttcatttgaaggtgagaccacagcccctgagtgctaaggggacctgggaatcctaggggaatggaggtggtggacgataagaggatggttgagggcaggagtttaaaggacacagaagctaggagagcagaaaatgtactccaccaccttctgtctaacttgtctcttaaaagtgcttttacattttaactttttaaaaaaatgtgggccgggcatagtggctcatgcctgtaatcccagcactttgggaggccgaggtgggcggatcacctgaggtcaagagttcaagaccagcctgaccaatatgatgaaaccccatctctactaaaaatacaaaaatagccaggtgtggtggcacatgcctgtcatcccagctactcaggaggctgaggtgggagaatcgcttgaacccgggaggtggaggttgcagtgagccgagatcatgccattgcactctagcctgggcaacgagagtgaaactctgtctcaataaataaataaataaataaaaaataaaaaagtgtgaacttaaatatatttatatgtgtgtacatatattttcttttttaatattctggttaaatgagaggccatcgggcctctttttaagagtctaatgatgtgtatatctaatgcccattccagctggattgtaacactgcttggggaagataacttaaaaaaaagtagtaccgagattacagcagctagtgtcctaaatggaaaagaagtgaaactaaatgtcataggagaaatcctttcagttttgtgcagtggttcatttgctgttaaatctaccccattaccattccccttactccttgaaaataaagtgatcttcatgttacaggaccattgctttatttatgtcacagatttcttgtcctttaattagtcagtgaaggcacatgattgcgatactactttttgattgccgtattgtaaaagctatatggtaaaaggtaactccctccacccgcccactgcaccctcacgtttaggggccacacagaaaaagcgaaataagatgaggtgaatctaatgagaaggcaactctaatgcccatcaggagattcactaggacattttaaaaggacgtctttaaggaaaaagttttgtttgtagatgttgcctctgattcctccctgcggctccagtccaggtcttggagccggccctcgaggggaatgtccgggactcgggtcggtacctttttggtctgggaatttccagtgtgcagaaaaaaaatccacaaatctaggcctcgctgccccctccctgcctcctctggccctcctcagtgcccacgcaacccggttcgaaagagaggatgaccgtattctgcattttagaaaacaggctcttagcttcccccgcccccgtcctcactagagtggagaactgaaagcgaacgctataaagggcgccagtgagaggggctggcctcctcttgccacgaggtcagacggcgagttcttagagaaaaaggctgcttagctgctgcttatcatgtaacctcaaaaggaaactgatcgtctttctcatgctgtcacgtacttgggttattatcgctgattacagctggaaacaattgatttgctcttacgtatttgtgtgacttgactcttcaaacacaaaggtatatttttattatctgatattttattaaaatatcttaaatggt

SEQ ID NO: 1196 - DNA, 12891 bp, Homo sapiens
gactgcttgcattaaaggacttcctcatcctttttttcatgaaactgagcttgcttaatcagagatggagcaaactgactgcaaaccctaccagcctctaccaaaagtcaagcatgaaatggatctagcttacaccagttcttctgatgagagtgaagatggaagaaaaccaagacagtcatacaactccagggagaccctgcacgagtataaccaggagctgaggatgaattacaatagccagagtagaaagaggaaagaagtagaaaaatctactcaagagatggaattctgtgaaacctctcacactctgtgctctggctaccaaacagacatgcacagcgtttctcggcatggctaccagctagagatgggatctgatgtggacacagagacagaaggtgctgcctcacctgaccatgcactaagaatgtggataaggggaatgaaatcagagcatagttcctgtttgtccagccgggccaactctgcattatccttgactgacactgaccatgaaaggaagtctgatggggaaaatggtttcaaattctctcctgtttgttgtgacatggaggctcaagctgggtctactcaagatgtgcagagcagcccacacaaccagttcaccttcagacccctcccaccgccacctccgcctcctcatgcctgcacctgtgccaggaagccaccccctgcagcggactctcttcagaggagatcaatgactacccgcagccagcccagcccagctgctccagctcccccaaccagcacgcaggattcagtccatctgcataacagctgggtcctgaacagcaacataccattggagaccaggcatttcctgttcaaacatggatctggttcctctgcgatcttcagtgcagccagtcagaactaccctctgacatccaataccgtgtactcgccccctcccaggcctcttcctcgaagcaccttttcccgacctgcctttacctttaacaaaccttacaggtgctgcaactggaagtgcacagcattgagcgccactgcaatcacagtgactttggccttgttactagcctatgtgattgcagtgcatttgttcggcctgacttggcagttgcaaccagttgaaggagagctgtatgcaaatggagttagcaaagggaacagggggaccgagtccatggacactacttactctccaattggaggaaaagtttctgataaatcagagaaaaaagtgtttcagaagggacgggcgatagacactggagaagttgacattggtgcacaggtcatgcagaccattccacctggtttattctggcgtttccagattactatccaccatccaatatatctgaagttcaatatttctttagccaaggactctctgctgggaatttatggcagaagaaacattccacctacacatactcagtttgattttgtaaaactaatggatggcaaacagctggtcaagcaggactccaagggctctgatgatacacagcactcccctcggaacctgatcttaacttcgcttcaggagacaggtttcatagagtatatggatcaaggaccttggtatctggcgttttacaatgatggaaaaaagatggagcaagtattcgtgttaactacagcaattgaaataatggatgactgttcaaccaattgcaatggaaatggagagtgtatctctggccattgtcattgtttcccaggattccttggacctgactgtgctagagattcctgccctgtgctgtgtggtgggaatggagaatacgagaaaggacactgtgtctgccggcatggctggaaggggccagagtgtgacgttccggaagaacaatgcattgatccaacatgctttggccacggcacctgcatcatgggagtctgcatctgtgtgccaggatacaaaggagaaatatgcgaggaagaggactgcctagacccaatgtgttccaaccatggcatctgtgtaaaaggagaatgtcactgttctactggctggggaggagttaactgtgaaacaccacttcctgtatgtcaagagcagtgctcaggacacggaacttttcttctggacgctggagtatgcagctgtgatcccaagtggacaggatctgactgctcaacagagctgtgtaccatggagtgtggtagccatggagtctgctcaagaggaatttgccagtgtgaagaaggctgggtaggaccaacatgtgaggaacgctcctgtcattctcattgtactgagcatggccaatgcaaagatggaaaatgtgagtgtagccctggatgggagggcgaccactgcacaattgctcactacttagatgctgtccgagatggctgcccagggctctgctttggaaatggacgatgtaccctggatcaaaatggttggcactgtgtgtgtcaggtgggttggagtgggacaggctgcaatgttgtcatggaaatgctttgtggagataacttggacaatgatggagatggtttaaccgactgtgtggatcctgactgttgtcaacaaagcaactgttatataagtcctctctgccagggctcaccagatcctcttgacctcattcagcaaagccaaactctcttctctcagcacacttcaagacttttttatgatcgaatcaaattcctcattggcaaggacagtactcatgtcattcctcctgaggtgtcatttgacagcaggcgtgcctgtgtgattcgaggccaagtggtggccatagatggaactcctctagtgggagtgaatgtcagtttcttgcaccacagtgattatgggtttaccatcagccggcaagatggaagctttgacctcgtggccatcggtggcatctctgtcatcttaatcttcgaccgatcccctttcctgcctgagaagagaacactctggttgccttggaatcagtttattgtggtagagaaagtcaccatgcagagagttgtatcagacccgccatcctgcgatatctccaactttatcagcccaaaccctattgtgcttccttcaccgctcacatcatttggagggtcctgtccagagaggggaactattgttcctgagctgcaggttgtacaggaggaaattcccattccctccagctttgtgaggctgagttacctgagcagccgcacccctgggtataaaaccctgctacggatccttctgacacattcaacgattcctgtaggcatgataaaagtacacctcacagtagctgtggaagggcgactcacacagaagtggtttcccgccgcaattaatcttgtctacacatttgcttggaacaagaccgacatctatggacagaaggtttggggcctggcagaggctttggtatctgtgggatatgaatatgaaacgtgccctgactttattctctgggagcaaaggacagtcgttttacaaggttttgagatggatgcttctaacctaggaggctggtctttgaataagcatcacattttgaatcctcaaagtggaatcatacataaagggaatggagaaaatatgttcatttcccagcagcccccagtcatatcaaccataatgggtaatggacaccaaaggagtgtagcctgcaccaactgcaatggcccagcccacaacaacaaactctttgctcctgtcgccttagcttctggccctgatggcagtgtgtatgttggcgacttcaattttgtaaggagaatatttccctcgggaaactccgttagtattttggaattaagaaacagagataccagacatagcacaagtcctgctcacaaatactatctggctatggaccctgtgtctgaatcactctatctatcagacaccaatactcgcaaagtctacaagttgaaatctcttgtggagacgaaagatctgtccaagaattttgaagtggtggcaggaactggtgatcagtgccttccctttgaccagagtcattgtggagatggtgggagagcatcggaagcttcactgaatagccctcgaggcatcacagttgataggcatggatttatttactttgtggatgggactatgattcgcaaaattgatgagaatgctgtgatcacaactgtaatcggctcaaatggtctgacttccacacaaccactgagctgtgactcaggaatggacatcactcaggtgcgattagagtggccaacagaccttgcagtaaatcctatggacaattcattgtatgtcttggataacaacattgtgctgcaaatttctgagaacaggcgtgttcggatcatcgcaggacgccccattcactgccaggtgccaggcatcgatcatttcctggtcagcaaggtagcaattcactccactctagagtcagcgagggccatcagtgtctcccacagcgggctgctcttcatagctgaaacagacgagaggaaagtaaaccgcattcagcaagtaaccaccaatggggagatctacatcatcgctggtgcccccactgactgtgactgcaaaattgatccaaactgtgactgtttttcaggtgatggtggctatgccaaagatgcaaagatgaaagccccttcctccttagcagtgtcgcctgatggaaccctctatgtggcagacctcggaaatgttcgaattcgtaccatcagcaggaaccaagcccacctgaatgacatgaacatttatgagattgcttcacccgctgatcaggaactgtaccagttcactgtaaatggaacccacctacacaccctgaacttgataacaagggactatgtttataacttcacctacaattctgaaggtgacttgggcgcgattaccagcagcaatggcaattcagtgcacattcgccgtgatgcaggcggaatgccgctatggcttgtggtgcctggcggacaagtatactggctgactataagcagcaatggagtcctgaaaagagtgtcagcccaaggctataatctggccttaatgacctatccaggaaacacagggcttctggctaccaaaagtaacgaaaatggatggacaaccgtttatgagtatgaccccgagggacacctgaccaatgcaacgtttcccactggagaggtcagcagcttccacagtgacctggagaagctgacaaaagtggagctagatacttccaaccgtgaaaatgtcctcatgtcaaccaacttgacggcaactagtaccatatatattttaaaacaagaaaatactcaaagtacctatcgggtgaatccagatggttccctgcgtgtcacttttgccagcgggatggagatcggcctcagctcagagccccacatcctggcaggggcagtcaaccctaccctgggcaaatgcaacatctcattgcccggagagcacaatgcaaacctcatcgagtggcggcagaggaaggagcaaaacaaaggcaatgtttcggcttttgaaaggaggctgagggcccacaacagaaacctactctccatagattttgatcatataacccgcacaggaaagatctatgatgaccatcgaaaattcacccttcgaattctttatgaccagactgggcgacccattctgtggtctcctgtaagcagatataatgaagtgaacatcacatattcaccttcgggattggtgacgtttattcaaagaggaacgtggaatgaaaaaatggaatatgaccagagtgggaaaattatttcaagaacttgggctgatgggaaaatttggagctatacctacttagaaaaatctgtgatgcttctcctacacagccagcggcgttacatctttgagtatgaccaaccagattgtctgctctcagtcaccatgcctagcatggtgcgtcacagcttacaaaccatgctttcagtgggctactaccggaacatctacaccccaccggacagtagcacttcttttatccaagactatagtcgagatggccgattgctacagaccctgcatctggggacagggcgcagagtcttatacaagtacaccaagcaagcaaggctttctgaggttctctatgataccactcaggtcacattaacatatgaagagtcttctggagtgattaagacaatacacctgatgcatgacggattcatctgcacaatcagatacaggcaaacaggacctcttattggacgccagattttcagattcagtgaagaaggccttgtgaatgcacggttcgactacagctacaacaatttccgagtcacaagcatgcaagctgtaatcaatgaaacccctttgcctatagatctttaccgatatgttgatgtctctggcagaacagagcagtttggaaaattcagtgtaattaattacgatttaaatcaggtcataactactacagtgatgaaacacaccaaaatcttcagtgccaatggacaagtcattgaagtccaatatgaaatcctaaaggcaattgcctactggatgaccattcaatatgataatgtgggccgcatggtaatatgtgacataagggtaggagtagatgccaatataacaaggtacttctatgaatacgatgctgatgggcaacttcagactgtttctgtaaatgacaaaacccagtggcgttatagttacgatctgaatggaaacatcaacctcttaagccatgggaagagtgctcgtcttactcctctccgatatgacctccgagaccgcatcaccagattaggagaaattcagtataaaatggatgaagatggctttctgaggcagaggggaaatgatatttttgaatataattctaatggcctgctgcagaaagcctacaataaggcttctggctggactgtgcagtattactatgatgggcttgggcgacgtgtcgcgagtaagtccagcctagggcagcaccttcagttcttttatgcagaccttaccaaccccataagagttactcatttgtacaaccacacaagctcggagattacatctctgtattatgatctccaaggtcaccttattgccatggagttaagcagtggtgaagaatattatgtagcctgtgataatacaggtaccccactagctgtgttcagcagccgaggtcaggtcataaaggagatactatacacaccttatggcgatatctatcatgacacttaccctgactttcaggtcattattggttttcatggaggactctatgatttccttactaaattagtgcacctggggcaaagggattatgatgttgttgctggcagatggacaacgcctaatcatcacatatggaaacagttgaacctccttcctaaaccattcaacctctactcctttgaaaataactacccagttggcaaaattcaagatgttgcaaagtataccacagacatcagaagttggttggagctatttggtttccaattacacaatgtactacctggatttcccaaacctgaattagaaaatttagaattaacttacgagcttctacggcttcagacaaaaactcaagagtgggatcctggaaagactatcctgggcattcagtgtgaactccagaaacagctcaggaatttcatttccttggaccaactacctatgactccccgatacaatgatggacggtgccttgaaggagggaagcaaccaaggtttgctgctgtcccttctgtttttgggaaaggtataaaatttgccatcaaggatggcatagtaacagctgatattataggagtagccaatgaagatagcaggcggcttgctgccattctcaataatgcccattacctggaaaacctacattttaccatagaggggagggacactcactacttcattaagcttgggtctctggaggaagacctggtgctcatcggtaacactggggggaggcggattctggagaatggtgtcaatgtcactgtgtcccagatgacttctgtgttgaatgggaggactagacggtttgcagatattcagctccagcatggagccctgtgcttcaacatccggtatgggacaactgtcgaagaggaaaagaatcacgtgttggagattgccagacagcgcgcagtggcccaggcctggactaaggaacaaagaaggctgcaagagggggaagaggggattagggcatggacagaaggggaaaagcagcagcttttgagcactgggcgggtacaaggttacgatgggtattttgttttgtctgttgagcagtatttagaactttctgacagtgccaataatattcactttatgagacagagcgaaataggcaggaggtaacaaaaatatctctgcctttgcgtcaccaaagactgcctgtttttaaaacataaaatggtttattgtattggttttctagatcagaactctgtatatgtaaatatggaggaaaaacatatccaactgcctttcaatgtgacggaagatggtattttaatattgtttgtttaaactctttaagaaatgacagagatttttagttcttgtgtggcagtattcaaaataacacaagtagaactcaaacagctaaaaacagttttcagaaagcaccactttcaatttgccgagccatgcatatgttccaatatccagaaagaacccaaggttctctatctctattgtgagaagcagtttcatccttaactgttggcagaacttacgggctatttgaataggtggtgcaatagtatctgaaacttgcctttcgaaagactgccagccctttgacgttttccagatctgttataggaaacttaaaaacaggtgtaaaatgtcttcagccaccatctcctagagtgaggacccaattgcccttccttcttgattattcctccttgcttgttaaagtaaatgccatattgttgtgctgtgttttggcgtgtggtggctgggttctgtctaccatgcttccctgtgggtgtggtaaccagactgtatagccgctatttgctcgtgtgtacatgataccaaagcagctggccagcgtgacctctctcacacgacctgttttgactcaattttttactaaaagttgttcagctgtattggtatcatgtaaacatagcttttattaacctgggtaggaatttctcatttatatataggatgtgttttggtcatagtttcacattagtgattcagtatctatacactgacccaatggttttgtgcacatgaacggtaatttacttaaaagtatgattctggtacaaaaacaaacaaaggctttagcaggcatacgtgtctgggatgccgatacatacattaactactactgcagaaattcataagagccaaaaccttaaaaaaatagacctggtacttaagtgaaagtactaaagggaagaccagaccaaacatcacagcagttgctgccacattgtttcagcccacttagatttatctttcaaatgtacaattctgtattgaacatctcccagccatcttcaggaaatcgaatcaagtaaatcctttccaaccgaaaacatttcaactaactatagagaggcagactcatttttactaaaataatttatacagttagttattttcgttctccgtacttacccatttatctttatttaatcgtctctactgcctaggaaaataactattttccaggacgggttatttgttctgcgatcatttaaaatttggagaaaggtcaggattagtgttaatatcagctgcagtttctcaatctctaggaatcctgcagtaaaacaagccccttggtgagctggaagatttgtgcccagtgacaaagagatagtttgtaaaatgctgtgtaattgtaagttaccacaaatgaaaatacatgacagcacaatgtggcccgtagaaaattcccctgagccagcttctgcactttcatcaccgaatctgaacatttgctatgtctgaaggcaaatttatgatggaatgttagtttggattctttccagatgctacctaaatgcagtgtggggtcattgccttgctttgcgatgacagtttctttgaaaatatgcaaagtcataagctcatgttaaggtttttcaagagtctgcctcctactacacaaaggaaagcaagggaaaggaaatgaccctggcaaacagtagggaagggtgtattcaaacatttcattttcaaaaccttcgggttagaataccacttacacatgtattctgagagacagaattcatgaggaactcatctctctttataactggaaacacaccagcttgatatattgctaatccatactaaaatcatattattgggttttttctgaatcaggcctgtattaatggtacagtatttattcagaatggaattctaaaattactaacaaacttgttgaaaatttgaatacctccacaccaacctaaaaatggaccttaagttcctagaacctctgatgttcttttaaattaatggaaaaataatttgtgaactgtatatagagagtgcattcataaatgtgattatgtattttatcacaaatccaaaatgtcaatattagagtctattttgcttatattttaagcaattatacgtttttgcaattcattgatgatgtatcattttcaaactgctttaaatatccattagaaacaaatatttgaagcttttacttaatagtgattaccttgaactgtgcatttctagtttgtaatacgtatttggttggttcgtgcctttagtttgttaaagttacatttgtattatattcaggaaatgcactttttattacttacagctgtggttttaatactgccttgaactattattattctttttacaactcctaaagcttgagggaggaaagaaaaaaaaaacaaaactactaatcagtagtaaatcgaagagaaacattttggcatttcttaagaagaagatggagatattgagtatatcacttcctattcagctgaatagaaagaatgccttcattgacttgcagttctgcagtttaaattattgaaagaacaattcgtttgcatttcctgatgaaagtaaaagcatttttcagagaaacatatgaatttctcatacccagcagacagatggctgacactgcacagccacacaccattcgagtaagttaaagtgagagcatagtagttggactctcctatgaagaacattctgggctggaggcagggaatactccatggttgtttctttttcctacttaagcccattttgtttgtgcttttctgttttgttttgttttcactcttgcactacagtctagagatccaaatgaactgaaaagttcaaagtttaacacatttaaatatgtttacttttagttgtcattctaatcgttattgattagaagcatgactcctgaaggaaagggaaataaatctcaattcatactaacttgcaacaaaacacttttaccatataaataagtatatgatttatttttaacccaaaaaatgtataaaataagtgtgtcctttactgtcaatttatctagaagatctataatatatagactacatatatataatatatacaacatagccaaatgtatgaaaacttgacaatgtataatttggaattcacatgctacctatgtagacaggtatgaaattaagttataattttcatgagacattttcatcactgttgacacagtttcaagcattccatcatgttattttgactctttttcttttttttttctttaaaaatatatttttaactagaccaggccccactataatatcacttaagagagtcagggcaaagtttttgcatttatgaagatgtgttcatgtaagggtgattgtaatggagttcattggtaatagaagcaaaagtacagtaacgaagtattgaaaagaaaattttggagacattggagcatattatatatagcttgtggaaagacataaggctacagatggaatggaacattcctgttttcttgaagaaattcacatacacatagctgacctgactagtacttcagctcttccacagccttctataaaggttctttcttctgcaaagaaaacaaaacaaaacaaaacaaaacaaaaaaaacaaaaaaagcgcaaaaaacaaaaaaacaaaaaaaagcaaagtaaaatttaaaaatacagaaaacaaacaacaaaaaagaattcaaccataaatagtgactattattttcagtgtgtccttcatgtgaaagctattaaggaccaaatatactactgttcataagaagaaattactttctaaacagtaactgaaaatacttagagttaaacttgctgtggattttgtcttggcagttgtcatcttacattatttgtcaaaggaaatgtgtttggcagttaaaaatctttccttagatttagtggtggactttaacctcttaaataaatgttagtatatcagattgtgtccttgaaaaatattttacttgtatgaatcatgacaacgtctaaatctttactattcttctggcaaaagcatcagtaagaaagaaggcgaaaaagagaagtatagcctttatgtcagaaaaacattctttttagctgcttactttctcatgaaaagtaaagatgtttacagtgtatgccaagttttcagtttctgtataacaacaggtagaggttctaatcatattgaaaattgtgttataatggtctgagccatgttgctaggaaacaataggttccaattttgtattcctgctctcctgtgctgaaaagtgactggatactgtacaggttcatgttctctggctgcagttaaatggtcttttgcattttgctctggctttcaggccagaagcatgcatttttctacaagagcatcacaacaacatgctgtaaatatttaaagttaaacattatgtgttgatatttgaaagaaaagtactttgaatatttcatttttaaaaaataaaattgccaatg

SEQ ID NO: 1197 - DNA, 486 bp, Homo sapiens
cgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggcacggtggctcacgcttgtagtcagcactttgggaggccgaggaaagtggatcacctga

SEQ ID NO: 1198 - DNA, 2413 bp, Homo sapiens
acaagtcctggtgtctttaaaaggatcagcttgaggaataaggctcgtctgagagctgtgacattcatctgactctagtgaaagtccaacagccactccctttttggcctccaactgggcaccatgagggcctgcatctccctggtattggccgtgctgtgtggcctggcctgggctggaaaaatagaatcctgtgcatctcgatgtaatgagaaatttaaccgggacgctgcctgccagtgtgaccgccggtgtctctggcatgggaactgctgtgaagactatgaacatctgtgtactgaggaccacaaagagtcagagccattgccacagctggaggaagagacagaagaggccctcgccagcaacttgtactcggcacccacctcctgccagggccgctgctacgaagcctttgacaagcaccaccaatgtcactgcaatgcccgctgccaagagtttgggaactgctgcaaggattttgagagcctgtgtagtgaccacgaggtctcccacagcagtgatgccataacaaaagaggagattcagagcatctctgagaagatctacagggcagacaccaacaaagcccagaaggaagacatcgttctcaatagccaaaactgcatctccccgtcagagaccagaaaccaagtggatcgctgcccaaagccactcttcacttatgtcaatgagaagctgttctccaagcccacctatgcagccttcatcaacctcctcaacaactaccagcgggcaacaggccatggggagcacttcagtgcccaggagctggccgagcaggacgccttcctcagagagatcatgaagacagcagtcatgaaggagctctacagcttcctccatcaccagaatcgctatggctcagagcaagagtttgtcgatgacttgaagaacatgtggtttgggctctattcaagaggcaatgaagagggggactcgagtggctttgaacatgtcttctcaggtgaggtaaaaaaaggcaaggttactggcttccataactggatccgcttctacctggaggagaaggagggtctggttgactattacagtcacatctacgatgggccttgggattcttaccccgatgtgctggcaatgcagttcaactgggacggctactataaggaagtgggctctgctttcatcggcagcagccctgagtttgagtttgcactctactccctgtgcttcatcgccaggccaggcaaagtgtgccagttaagcctgggaggatatcccttagctgtccggacatatacctgggacaagtccacctatgggaatggcaagaagtacatcgccacagcctacatagtgtcttccacctaatagaacttcgagccagaaaggggcatgagggctcttgcgagactgaagtgctatcttctctggactagagagaagagggagaggactggaagggatcaccaaatctcaaagcaatgagaagcattcctaaatcccaaagtgcccacatgggaaagagataaaatgtacaaattagaaaaatgtggataaacagtcaaacctttatcctctagaattttggcaatgttgactaagaaacagagtccaagcagagaaggtaggaaccctccatagctctctgccctgatgtgtgggggaactaggaagaagtcctttgacctcaccaggcctcatgcttccctttaatgtaaagggaaggggtttgcccactttcctctttttggggttggtgagagggcaaaccctgatatttttactgtgaaggtgttttcagttgttcttaggaagaacagctgatagaaattcaagattactataatggctgttattatacacagctctgtaaactaccactcagccctgtgttggggtcctcaaagaagtaaggccacagtaatcaagcaagggcctttggttttttccagagttagatcctctcagaacagagtctgggagaactccaatgctgaatggagaagggtaataggttggtgcagtgaatgggctgggggtggggtggccttctccaggcctgagtgtttttgtgtccagctcagtatctgcaacaagaagtttcccacttgtggatgtttagtgcagccacagacttgtattttgatccccaatttttttttgaaagagttctcctcataggaggatgattcagcatcagaagaagaaggaacccatagcttggtgtcattaacataattattttaagccttatccagcagccataatttgaataactctacgagaccagagagactgtagttccctattttaacctcaattatgcatttgtcccccaaccccactgagaactaaatgctgtaccacagagccgggtgtgaactatggtttagaaggttcaagtttccaattaaagtcattgaag

SEQ ID NO: 1199 - DNA, 709 bp, Homo sapiens; identical to SEQ ID NO: 820

SEQ ID NO: 1200 - DNA, 1513 bp, Homo sapiens
ccgtcatccccctgcagccacccttcccagagtcctttgcccaggccaccccaggcttcttggcagccctgccgggccacttgtcttcatgtctgccagggggaggtgggaaggaggtgggaggagggcgtgcagaggcagtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgagggggtgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcaaggccagggtaggtgggggccgggagggacccaggtgtgaacggatgaataaagttcaactgcaactg

SEQ ID NO: 1201 - DNA, 682 bp, Homo sapiens
acaggacgaaggtaagaaaagccagcctatgttacaggacaaaggccgtcgctttgtaaaagcttgaagtgcagtttgctgctgagtacagaagacctttgcaaacagagaggggagattttctctgtaaggttgcaaacaagagcaggtcctggaagataagattccccgccatgttatcctccgtggtgttttggggactaattgccctcattggcacttccaggggctcataccccttcagtcactcaatgaagcctcacctacatccacgcctgtaccacggctgctatggggacatcatgaccatgaagacctctggggccacttgtgatgcaaacagtgtgatgaactgcgggatccgtggttctgaaatgtttgctgagatggatttgagggccataaaaccttaccagactctgatcaaagaagtcgggcagagacattgcgtggaccctgctgtcatcgcagccatcatctccagggaaagccatggcggatctgtcctgcaagacggctgggaccacaggggacttaaatttggcttgatgcagcttgataaacaaacgtaccaccctgtcggtgcctgggatagcaaagagcacctttcacaggctactgggattctaacagagagaattaaggcaatccagaaaaaattccccacgtggagtgttgctca

SEQ ID NO: 1202 - DNA, 4564 bp, Homo sapiens
ccggggccctacacgccagacctggctcggggtgggagtgcagaggcaaccaaaaaggaacccacacctccctccagggcccggggcgctgtcagacggggcagcaaccaggagattccctgggcctgcaggaagcccttccgcggaccgaaagattgttccccattttggagatgaagaaactgagactcaaagcagctgagtgaccttcccaaggacacacactgaactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgccagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcaaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatatactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtaagtgtgtgtacactgttcaatatggttcaatatggtaccaatagccacatgtgactatttaaattcattgcaatgaaataaaattaaaggtatactagctc

SEQ ID NO: 1203 - DNA, 1033 bp, Homo sapiens
gtcaatagatgaaacaaatacttcatcctgctctggaaaccactggaatggaacaaagaggctgcagcaaatgcccaaaagtgggcaaaccagtgcaattacagacacagtaacccaaaggatcgaatgacaagtctaaaatgtggtgagaatctctacatgtcaagtgcctccagctcatggtcacaagcaatccaaagctggtttgatgagtacaatgattttgactttggtgtagggccaaagactcccaacgcagtggttggacattatacacaggttgtttggtactcttcatacctcgttggatgtggaaatgcctactgtcccaatcaaaaagttctaaaatactactatgtttgccaatattgtcctgctggtaattgggctaatagactatatgtcccttatgaacaaggagcaccttgtgccagttgcccagataactgtgacgatggactatgcaccaatggttgcaagtacgaagatctctatagtaactgtaaaagtttgaagctcacattaacctgtaaacatcagttggtcagggacagttgcaaggcctcctgcaattgttcaaacagcatttattaaatacgcattacacaccgagtagggctatgtagagaggagtcagattatctacttagatttggcatctacttagatttaacatatactagctgagaaattgtaggcatgtttgatacacatttgatttcaaatgtttttcttctggatctgctttttattttacaaaaatatttttcatacaaatggttaaaaagaaacaaaatctataacaacaactttggatttttatatataaactttgtgatttaaatttactgaatttaattagggtgaaaattttgaaagttgtattctcatatgactaagttcactaaaaccctggattgaaagtgaaaattatgttcctagaacaaaatgtacaaaaagaacaatataattttcacatgaacccttggctgtagttgcctttcctagctccactctaaggctaagcatcttc

SEQ ID NO: 1204 - DNA, 4510 bp, Homo sapiens; identical to SEQ ID NO: 933

SEQ ID NO: 1205 - DNA, 658 bp, Homo sapiens
acaacttcaagggaggtgccctgtggttgccccatgcttccctcctggccaccaggaatcaggacaagcaaagaacacgacattcacagtccagggaggtcacacagtccggaaaggtacaaagggtttggagaactcacttcatttggtttgggagcctccgcaggtggacacggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaa

SEQ ID NO: 1206 - DNA, 1524 bp, Homo sapiens
cgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgc

SEQ ID NO: 1207 - DNA, 2096 bp, Homo sapiens
gtccctagagacagcctggaaagattgggtgccagctgcagagaggagagcaaggcgaccaaacgcagggtaaggtctggaggtgctcatagttcactacgggacatgtacatggaagtgaataattatgtcacaaggtgccaagggggctagttacctcacataggatcttagaaaaggtctcctggagaccatgtctgagctggtcctgaggtgtgagtagggattctccgcagggcggggaaggacttgaaagagtctggcaatatggagcacatcaggattatggaagctgtggctgcctgcagcccatcctgcccccagcacctagagtcatctttagaaatgcaagcctgatcgtggaatccaccttcctaacacccttcagtgccctcctcttcgttacacccttactatacaaacgatagtccatggaccagcagcatcaacataaccagggagcttgttagaaatgtagaatctggtccatcccaaacctgacgaagcagaagctgcattttgccaagatcccagggaatttgtgtgcccgttatggtttgcgaagtgcttcccaagagaacatacggcaagccagagggatctttgcagatcttgctcctttcattctctggcctcatcttgtcgctctcctccatccgtgcccacatccccactgtactggaccgcttgcagctccttgaatgcagcatagtcttgttttcttttttgcagtgattctacatctttcccatcttctccacctggatgcctccatccatcctttcagacttcccttctctagcaaacctttcttgctaattcccatgtctaacacaacacttccccatactgcatggccattatcctttctgcatcagactgtgagcaccttgaaggcagtggcagtgactcattcattgtggcatctgcagattccagtggactgccaggcatgcaatagaaaatcaaaaaagatttactgctaaataatcctcaactccagtggcagctccatgtgccatttctcttccgctctggcctcggctcttcctgtgcctacctggggcttggctttcacctaggtgtctgcatggaagggagagcgacctggaggaccatcgccaatccatcaatagcctcccggttgagatgacttcagctctgatttggaagagctatgatattgtttataggagtgaattaatatgtgtaaaggttacaaagtaaacagttaaattaaattaattgtgctggagcaggtcaaacaggcttctgagagatgaacatacacatctctattaactccacattcagtgagtgtgggtaacttgaaattggctgggtcaccatttacatcatagaaattggcaaatagtacaaattagggctccctcacccctactcgggcatagagctggtacactagcacacctctggttatacatgcatgcgtgtgccaccagaacaaaacacctaacagcaggcacgttgcctctgttgcccaccattacagctcccgcacggagcagacagactcatggcaggaattgaatgcatgtttgtcgagtggaagcatgaacaaatccacaaaatgcccaagatgaggcaaagaaggacattggctcaaatgttaaacataagttaggagctgagataatgcccagaggaaaaatgttctgtaattctaagtaaaacccatctctaaggcaggatgctgcttatgagggctccacagacagatgggggaggcctgggtcctgcccttggaaagagtctgacagctcgacttctggaaacagccatctgcacaggtcaacatcttcttagctgacagggagcagatttgcagaccacatcacatttgaaattccagaagaaacttcttggagtctgctcttgtgcaaatgagcctagaaagcccgttaactttgggtggaggcttccactgtttggctatcccaagtgggcccaaagctaaggaaaacccaccagccctttgcttcctgcttcctctatttgtttgccccaggaaatcagaggtgatgacatgatttggcttgggcacgacaggaataaacgatatttaagagacgtca

SEQ ID NO: 1208 - DNA, 1687 bp, Homo sapiens
atccatgctaaaggtaaacaaactgcaacttatatctgcaatttattttggtatagacaagaggtatgccagtagcacactggtggcttcagaagaaattctcaacacctagctcgccagagagtctatgtatgggattgaacaatctgtaaactaaaggatcctaatcatgaaaataagtatgataaattataagtcactattggcactgttgtttatattagcctcctggatcatttttacagttttccagaactccacaaaggtttggtctgctctaaacttatccatctccctccattactggaacaactccacaaagtccttattccctaaaacaccactgatatcattaaagccactaacagagactgaactcagaataaaggaaatcatagagaaactagatcagcagatcccacccagacctttcacccacgtgaacaccaccaccagcgccacacatagcacagccaccatcctcaaccctcgagatacgtactgcaggggagaccagctgcacatcctgctggaggtcaaatgtgggtgtagagattatggaaaaattcaatacaattagtgtctccaaatgcaacaaagaaacagttgcaatgaaagagaaatgcaagtttggaatgacatccacaatccccagtgggcatgtctggagaaacacatggaatcctgtctcctgtagtttggctacagtcaaaatgaaggaatgcctgagaggaaaactcatatacctaatgggagattccacgatccgccagtggatggaatacttcaaagccagtatcaacacactgaagtcagtggatctgcatgaatctggaaaattgcaacaccagcttgctgtggatttggataggaacatcaacatccagtggcaaaaatattgttatcccttgataggatcaatgacctattcagtcaaagagatggagtacctcacccgggccattgacagaactggaggagaaaaaaatactgtcattgttatttccctgggccagcatttcagaccctttcccattgatgtttttatccgaagggccctcaatgtccacaaagccattcagcatcttcttctgagaagcccagacactatggttatcatcaaaacagaaaacatcagggagatgtacaatgatgcagaaagatttagtgactttcatggttacattcaatatctcatcataaaggacattttccaggatctcagtgtgagtatcattgatgcctgggatataacaattgcatatggcacaaataatgtacacccacctcaacatgtagtcggaaatcagattaatatattattaaactatatttgttaaataacacaaaagtctgaaattcattcacttaagtaaaaaaatttattgactgtctactagcaggccagatgctgtgtttggctctgaattcccaactagcaagagcagagaatctacattatggctgatccataagccaccaattcagctaaatgagatgtttctaatctgggcttccacttaaaaataaaactaaaaatactcatgaaaagagcctacccttcttgatcagagccatacccctcttcaccaatgggaagtcaagacacctatgggtaaaagttctctctgatgcatgaaaactcagagtgataaagtaattttaaaataaaaatttggagaaagca

SEQ ID NO: 1209 - DNA, 1896 bp, Homo sapiens
atgtcctcaaatacaatgcttcaaaaaacgctgctgatcttgatctctttttcagtagtaacctggatgatttttataatttctcagaacttcacaaagctttggtctgctctaaacttatccatctctgtccattactggaacaactccgcaaagtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctactggaggtgagggaccacttgggacagaggaagcaatatggtggggatttcctgagggccaggatgtcctccccagcactgacggcaggtgcttcaggaaaggtgatggacttcaacaatggcacctacctggtcagcttcactctgttctgggagggccaggtctccctgtctctgctgctcatccaccccagtgaaggggcgtcggctctctggagggcaaggaaccaaggctatgataaaattattttcaaaggcaaatttgttaatggcacctctcatgtcttcactgaatgtggcctgaccctaaactcaaatgctgaactctgtgaatatctggatgacagagaccaagaagccttctattgtatgaagcctcaacacatgccctgtgaggctctgacctacatgaccacccggaatagagaggtatcttatcttacagacaaggaaaacagccttttccacaggtccaaagtgggagttgaaatgatgaaggatcgtaaacacattgatgtcactaattgtaacaagagagaaaaaatagaagagacatgccaagttggaatgaagcctcctgtccctggtggttatactttacaaggaaaatggataacaacattttgcaaccaggttcagttagacacaattaagataaatggctgtttgaaaggcaaactcatttacctcctgggagactctacactacgtcagtggatctactacttccccaaagttgtaaaaacactgaagttttttgatcttcatgaaactggaatctttaagaaacatttgcttctggatgcagaaagacacactcagattcaatggaaaaaacatagctatcccttcgtcactttccagctctactctctgatagatcatgattatatccctcgggaaattgaccggctatcaggtgacaaaaacacagccatcgtcatcacctttggccagcactttagaccatttcccattgacatttttattcgcagggccatcggtgttcaaaaggctattgaaagactgttcctaagaagcccagccactaaagtgattattaagacagaaaacatcagggagatgcacatagagacagagaggtttggagacttccatggttatattcactatcttatcatgaaggatattttcaaagacctcaacgtgggcatcattgatgcctgggacatgaccattgcatatggcactgacactatccacccacctgatcatgtgattggaaatcagattaacatgttcttaaactacatttgctaagggataaatactatacaaaatcactaggaaccaatctctgcacataatcccacatgtattgtaaagtaagttttactcattttaggaactaaggaaaataaatttaaaagaatctgtttggggaggaaggctatgtaaggacaatgacaactgataagggatgcaaaaccaagagaatcattcatgaagaatgactataccatgcctggttctgatgctcgtttaaaatattaaaaaagttttttaaaagcc

SEQ ID NO: 1210 - DNA, 924 bp, Homo sapiens
gtagttcacggctgccccggctccaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagtgggtacatgccctcgccagacgccagctttctgatctgcgtctttagattttttccatcgcctaagcgttacttctccactgatcggtgagtttagtgatggccagagctcactggaggacaatggacttggataaccaaaggtcagggcttggtcataacaatgactttattaccgggaaggacgagtcaaaaaataggaaggcctgggaaccctcaggctcgccactctaggttttagagacctgaaacatcacagaagcttctgagtggttctgaagattcaagaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgccagagagaggctggaggagatgcat

SEQ ID NO: 1211 - DNA, 1462 bp, Homo sapiens
tggagggagaggagagattaaagtgaggagagagctacaaccaagtaagcaagtgtcagggctcaccaaccatgcaaggacagggcaggagaagaggaacctgcaaagtccatgaagcagaaacatcaaaaagcatgggatttggaatttgagacctgactttgaagcccacacagaacacagacaagtcaaccatgctatttgggcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcatctgtcaacaga

SEQ ID NO: 1212 - DNA, 568 bp, Homo sapiens
gagatgaagcctgatagatccgcccaggtgtaggtgaaatggtagagcctcaggggtaatagattctgtgctctcatgctgaagtttagtgctgtgtcttgactggctctctagcatcagtgtgatgggctgctcctggtacagttacaaagtgaacatgcttcttgctgctcacatttatccctaatctggagggcaacctggagctaggtaagaacagaacagccctttgacttcaacgcatggacaaaggacaacaaaggcaaatatttaaaaaaaccatccatgggacagtctaacataacaaagggaattattcatcaagaagaggccctttagcagggtatttaaagtgcccaggtacttacaataacaagttggactgaacacattgtatctcaggaattaagaatttttcctaaaagaagtttccagattgtttgaacttctctggccgcacaatacaggaaggaagactaaagcagcaaagggacctacagcgtctgcagcatgggctggttaactaggattgtctgtcttttctggggagtattacttacagcaagag

SEQ ID NO: 1213 - DNA, 1293 bp, Homo sapiens
gcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgaggaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcc

SEQ ID NO: 1214 - DNA, 517 bp, Homo sapiens
ggtatctcagcaaccgctgggcatccggaggatgtggggacgcggagctgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggagtagagacagggttttgccctgttggccaagctggtcttgaactcctgacctcaagtgatccacccgcctcggcctcccaaagtgttgggattacaggcgtgagccatcgtgcccagccagattctccatttctaacaagttcccaggtgatgtcgatgaagctggaatccgacacgtgacggtctgtccgccgtctcagactagaggagcgctgtaaacgccatggctcccaagaagctgtcctgccttcgttccctgctgctgccgctcagcctgacgctactgctgccccaggcagaca

SEQ ID NO: 1215 - DNA, 844 bp, Homo sapiens
cctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctggcctgcagcatggcccagctgttcctgcccctgctggcagccctggtcctggcccaggctcctgcagctttagcagatgttctggaaggagacagctcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcc

SEQ ID NO: 1216 - DNA, 2687 bp, Homo sapiens
gaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaacatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaaccagacacctgacatagagtctttattttaccccaagttttttgggccactgacattgaatgcaacaactgatttcatacaactgagttactctgttcactccactgaatgcaacccatatagtttcttgcacaaggtgcatctggattccaaatattggatttgagttgactctactcatttattatacactaaagaaattttgttcttcatagttaaatgtactagcatttaatttatattttacatacaacttgcaataatgaaattccttatgtcaggaccctgaaaataagcacatttgaaaactcttagaaaaaaaaaattctgtaatgtcctctagatttagattatgagccctgaggagttattggcaagatttgtgcaaaataaaatatggggagacttgggagttgtctttgtggtttcaaaagtgtaaataaccaattcagaaaacaaaatggaaaaacgaccccttgttaccttgattcactgtatgtggaaaaataatgtaaccaaaagggaagagctttaataatacttatgttaataactctatgaaacatataagctaactatatatcaaacatttcattgagtttggatgtattttccacatattaaaaaaatagttccctaaggcagctttatggaaactaatataggttggttttacaatttaaaaagtatattctataataaataataaaacaaattgttttaaatgtttagtttcacacatacatagtaccatgattttctttgaaagataaggatgtaatgatttagataaagcatcatgtaaagaaatcctaacatttaagtgtaattcatttcaaatgtcacaagtaaagcatcatcctcaaatatctcactgtcaaaattgtagaattaaataacccaatcttgaaactg

SEQ ID NO: 1217 - DNA, 702 bp, Homo sapiens
ggaggtgaggcggaactctgaggcagatatcctccctttcctcctcggctgctgctcttactttgacaagccaggctaacattgaaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccatac

SEQ ID NO: 1218 - DNA, 4510 bp, Homo sapiens; identical to SEQ ID NO: 933

SEQ ID NO: 1219 - DNA, 710 bp, Homo sapiens
ccccaaacctgccaccgacggccacttccgtttccccgatagtatttggggatctcgaagcgatacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 1220 - DNA, 2970 bp, Homo sapiens
atggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacagttcatcattcccctgcatattcttttcctgctgctatccagagaaatcagcctcagcgccctgaaagcttccttttccgagcaggtgtcagggcagaaaccaacaaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcc

SEQ ID NO: 1221 - DNA, 1109 bp, Homo sapiens
tctgcctgctgtcgggggcgggctggccaggccgaggccggagcaggcaggcatccccgggagttgtctcttttcatgccagcgccaacaggaggctgtctggacacactgattactcactcaccagcctccttcttttgttcaccagcccccctcttttgtccaccagcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccacctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctgctcgtgtgggccacctcaagccagctgggctgtgggcggcacctgtgctctgcaggccagacagcgatagaagcctttgtctgtgcctactcccccggaggcaactgggaggtcaacgggaagacaatcatcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaaggtcacctcccaaactccaatatgcctcactctgcaatggggaccaaaccaaagacaccaggcgtgccagcaatcggaagccttgtgaggtgcagcctgcagtgtgtgcacggccggttccgggaggaggagtgctcgtgcgtctgtgacatcggctacgggggagcccagtgtgccagtgagtcctgccccagggcccccaaagagccagctcctctcaagaccccccttcaatggggcatcagctcccaggagcccgctgtgtgcctctctttccaactcattcagtga

SEQ ID NO: 1222 - DNA, 583 bp, Homo sapiens
gagccgcctgcgcggatcggcgtccgcagcgggcggctgctgaggggaaattcacgttacctctccacgtgccgaccaaggctctgagacccccagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtc

SEQ ID NO: 1223 - DNA, 922 bp, Homo sapiens; identical to SEQ ID NO: 819

SEQ ID NO: 1224 - DNA, 922 bp, Homo sapiens; identical to SEQ ID NO: 819

SEQ ID NO: 1225 - DNA, 1569 bp, Homo sapiens
gagccgggaggcgcggccggcatggaggcgctgctgctgggcgcggggttgctgctgggcgcttacgtgcttgtctactacaacctggtgaaggccccgccgtgcggcggcatgggcaacctgcggggccgcacggccgtggtcacgggtatcagttcctgtggccggacccgtgaggcgtttaacctgctgcttcgggtgaaccatatcggtccctttctgctgacacatctgctgctgccttgcctgaaggcatgtgcccctagccgcgtggtggtggtagcctcagctgcccactgtcggggacgtcttgacttcaaacgcctggaccgcccagtggtgggctggcggcaggagctgcgggcatatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgcc

SEQ ID NO: 1226 - DNA, 761 bp, Homo sapiens; identical to SEQ ID NO: 929

SEQ ID NO: 1227 - DNA, 1140 bp, Homo sapiens; identical to SEQ ID NO: 240

SEQ ID NO: 1228 - DNA, 3845 bp, Homo sapiens
gatcccagaagtaggaggggcgtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1229 - DNA, 1606 bp, Homo sapiens
agacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaatgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcac

SEQ ID NO: 1230 - DNA, 2481 bp, Homo sapiens
agaagggagcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagacgagcacatcccagctcctcttgaccaaggcagtgaacagcctcttttccaacccctggatcaccaagccacaagtttgccttcaagggatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcattccacggcaaccttcaaatgacttgtttgaaatatttgaaatagaaagaggagtcagtgcagacgatgaagcaaaggatgatccaggtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtgaaattgacttaccctcttcactta

SEQ ID NO: 1231 - DNA, 237 bp, Homo sapiens
tcttctcctgacccagcatcgctcatcacaatgaagaaccaagacaaaaagaacggggctgccaaacaatccaatccaaaaagcagcccaggacaaccggaagcaggctcctttgattctctagacctggaaaaggtgtccctaggcagagccctggcagggcgctcagagctggggatttcctgcctggaacaagggacctggagaatgtttttgcgtgggatgatgtgctggtca

SEQ ID NO: 1232 - DNA, 929 bp, Homo sapiens
gtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctgggg

SEQ ID NO: 1233 - DNA, 676 bp, Homo sapiens
gtcacttctccaagtagtgaatcatgttaactacttgattgcattgcattttatagatttattttctttctttctttttccttcatctagatcattcgtaactgaggcacacttgccttttgcaactaagctctactgaattccaaagctatagaaatatccatcttgacctggaaagtctgtttctttgctagtccagaaggttttttttaacatgaacaagatcctctcaagcactgtttgctttggactcctaactttgttatccgtgttgagttttttacaatctgtgcatggacgaccatatcttacccaaggaaatgaaatatttccagataaaaaatatacaaatcgtgaggaactattgctggctctactgaataaaaattttgatttccaaagacctttcaacactgacctagccttacctaacaaactggaagaacttaaccagctggaaaagctaaaagaacagctagtggaggagaaggattctgagacgtcctatgctgtagatggtctattctcttctcatcctagcaaacgagcttgcttttggaaatactgtgtttaaagctttttctctggatgcaaaaaaagataagaatatcaggaaaatatatgtatctactcactctgctgtaggcagaccccctgaaactattgctgtggaata

SEQ ID NO: 1234 - DNA, 2920 bp, Homo sapiens
gttcagtgactgagacaaactggaggtgaaaggagctggtactgtccactgtgctgtcggtgctgaacctgagacgcgagcggaccagttgctccagcacctgaaggcaacgccctcttgcaccctctgtgccctgtgggacccgcttcaccaacaggacccatatcaacttgacaaaggagtgtggtatcggacgtgggagagagtcctctgtttgccacctgggcgctcattcaggcgtgactttggagatttctatagttttagaccaaactatttttttttccccagctaagacgatcttttgagagttttttttttttattgtgatttatatttccacagcgtttaggaatctttctgggggacttttgtgactgttaaaataaggtgaaaagcaataaggatgtttaagtgctggtcagttgtcttggttctcggattcatttttctggagtcggaaggaaggccaaccaaagaaggaggatatggccttaaatcctatcagcctctaatgagattgcgacataaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagacccgtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaa

SEQ ID NO: 1235 - DNA, 739 bp, Homo sapiens
ctgatcgcagtccggaggcagatatcctccctttcctcctcggctgctgctcttactttgacaagccaggctaacattgaaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaaga

SEQ ID NO: 1236 - DNA, 5912 bp, Homo sapiens
gcgttccttgcggcccggccgacctcgcgggcttgggcctgggcgggcaccgacggagcggccctggctgcagcctcccggcgccagcgaagacaggctgagatgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgaggctacaaccagatcctcatagttcccatgggtgccaccagcatcctcatcgacgaggctgctgccagcaggaacttcctggctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgcctaccccgtgcggtgcctgctgcccagtgcccatggctcttgcgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaacgggctacctgtgcaggctgatggccaccgtgtccaccagtccccagatggcacgctgctcatttacaacttgcgggccagggatgagggctcctacacgtgcagtgcctaccaggggagccaggcagtcagccgcagcaccgaggtgaaggtggtctcaccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagacagagtttcactcttgttgcccaggctggagggcaatggcgcgatctcagctcactgcaacctccgtctcctgggttcttgattctcctgtgtcagccttctgagtagctaggattacagatgcctatcaccatgcctgggtaatttttgtatttttagttgagatggggtttcaccatgttggccaggctggtctcgaacttctgacctcagatgatctgcccgcctcagcctcccaaagtgctgggattacaggcatgagccaccacgcccagccatcaatgcattttttttattttttttttgagacagagtttcgcacttcttgcccaggctggagtacaatggtgcgatcttggctcactgcaacctccacctcctgggttcaagcgcttctccagcctcagcctcctgagtagctgggattacaggtatgtgccaccatgcctggctaattttgtatttttagtagagacggggtttctccatgttggtcagactggtcttgaactcccgacctcaggtaatccgcccgcctcggcctcccaaaatgctgggattagaggtgtgagccactgtgcccagcccatcaatgtgttttaaagctagctgtcagggttccacttaatttaaagctgggcagggagatgtgtaatgatttcaaagttaacacctgtttgttttctaaagggcatgccaagtcctgctgtatcagggaagtattctgtgctaaaatcagcgatggttcattgctctagtctctctcacccttctaggcagtgcatcagtcagctctaaatctggtgcagagggttaacagcataacccttgttggcaaaatggaatagatgttaagacctcaaatagggatttgggatgaaacagctgcagttagcactgttatctgagcatgaaagaactggaaacgctccttacgtcgagatgttggaccttgaagccctcctgaggccaacatgcaaatctggctgtgacggttcatctgacacctgtgtaaagctgaccagcctgctctgtacagtgacaatgaggagcccctctcttccttaagtaggaatctgtgaagcaaaatgtttgctgccaaagacaaatcagactgtcagtcattaaaaacagcattagcaggatgaggatagcaatggggaagggttgtgggcaatgcagtaacagggaaatggcttcagaaatggtttgagttggaagacaacattcttcatctctcaggacttctaattccttgatgctaaaagaagaggcatggattctatgagcttccaagtccctttccactttaaccttctacaaatctttcagaggactgcctagtagcaaaggttattcctggacacaggaaagacgggcattacagggaccaaagctctgaaaggtgacttttattaccaacacactggctggaaaagggacaaaccacatcacgggtgagtgatacttctcagtcttctctactcattcaacaaaggaaatgtgggctggggcagaggtcttttttcatttaatactggaaaaatattgaagagcatccatgttcacttatggctggttttgctatagaaattggaaaataaaggccacttttttgaaatccccagtttaatt

SEQ ID NO: 1237 - DNA, 3205 bp, Homo sapiens
caaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacacca

SEQ ID NO: 1238 - DNA, 1257 bp, Homo sapiens
gggagccactgggactactgggtccgggagggggaagggagggctgcgagcccgaacgcgcggcgagaaggccgaggggagggaggggagcgaggagcgggaggaggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctat

SEQ ID NO: 1239 - DNA, 888 bp, Homo sapiens
gacgcggagctgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggagagacagggttttgccctgttggccaagctggtcttgaactcctgacctcaagtgatccacccgcctcggcctcccaaagtgttgggattacaggcgtgagccatcgtgcccagccagattctccatttctaacaagttcccaggtgatgtcgatgaagctggttcgtgaactgcactttaacatgatgtagaaattttacaaactagtagagtaagggggtggctgcaggctggagaggaagtccaggctaaacgcctggcaacttgaggtggtttccgcccccttgctcgctgaggttccctcccaggaatccgacacgtgacggtctgtccgccgtctcagactagaggagcgctgtaaacgccatggctcccaagaagctgtcctgccttcgttccctgctgctgccgctcagcctgacgctactgctgccccaggcagacactcggtcgttcgtagtggataggggtcatgaccggtttctcctagacggggccccgttccgctatgtgtctggcagcctgcactactttcgggtaccgcgggtgctttgggccgaccggcttttgaagatgcgatggagcggcctcaacgccatacagttttatgtgccctggaactaccacgagccacagcctggggtctataactttaatggcagccgggacctcattgcctttctgaatgaggcagctctagcgaacctgtt

SEQ ID NO: 1240 - DNA, 917 bp, Homo sapiens; identical to SEQ ID NO: 374

SEQ ID NO: 1241 - DNA, 1833 bp, Homo sapiens
gggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtgaccaatgcactgcactccattctaggtgaaggaaatgtccctgatccgaaacaccattatggagtgtcaggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagaccttcacctcacctggctgactgccaggggtctgattgtatggagagcaggctccagagactcccaggcagaagcgaagggaaggacaaggagtacctttaaatcctttatttggtacctgttcttctgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtga

SEQ ID NO: 1242 - DNA, 1084 bp, Homo sapiens
gctctacctcttggacttccaacttctgtgagtcaacatagtgcctcttgcatttaagaaacatctcatcacactcttatcagcattgagttttgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 1243 - DNA, 355 bp, Homo sapiens
ttgctttgctgttagcctgttggaccttcgagcctagctgctcgcacaggactcggccacctgcccttcctgcaccgactggccaggagttcagagcctcatgctgagccaggaggagctccgggtgacgcatacggcaggatcgggattgagaggctgaaaaactcaagaggtttggatatggaccttcttcaattcctggccttcctctttgtcctgcttttgtctgggatgggagccacaggcaccttgaggacctccctggacccaagcctggagatctacaagaagatgtttgaggtgaagcggcgggagcagctgttggcactgaagaacctggcacagctgaacgaca

SEQ ID NO: 1244 - DNA, 3249 bp, Homo sapiens
acccctcacacacaggtgaaggcgtggctgtagaacctcagaccccctggtctcctcaggaatgaaggtcattgccatcctcaccctcctcctcttctgctcccccacccacagcagtttctggcagtttcagaggagggtcaaacacatcacggggcgaagtgccttcttctcatattacggatatggctgctactgtgggcttggggataaagggatccccgtggatgacactgacaggcacagcccctcatctccctctccctacgagaagctgaaggagttcagctgccagcctgtgttgaacagctaccagttccacatcgtcaatggcgcagtggtttgtggatgcacccttggtcctggtgccagctgccactgcaggctgaaggcctgtgagtgtgacaagcaatccgtgcactgcttcaaagagagcctgcccacctatgagaaaaacttcaagcagttctccagccagcccaggtgtggcagacataagccctggtgctagggacaccacagggtccctctcatcatccagcatccgctctagtgttgctcttccaggaagccttctcagatcatccccaacaggcccctgttcttccactgggagggaggacaaaatgtctcccgcagggcagctcacccttcagcattctgaccaaggggactccctgtcgttcagcatcagagggctggagagcagaaatgggaaagatgagatgcctgccctgcaggagctggcattctgtggagtggggaggactacaaatgcatggatatagaagtaagagacacattagactgtagtaagtgctatgatgcagtaaaacaaagggacgggatagagatgcacccaaccccacatcccagggtttccaggaggggagaagccccaggatctaccccaaactctctcttcacccccactgcaaaccgggacacagagcagacttgagcgccaggcccatgcccagctctagctggcaacaaagccaccactttccttgcccctctgcgtcctcagtttttatgatgtcattcttagcttttcttatcaagaggcagaatctgttttccccatcccatgaatctgaactggtcttgtggcttagtttggtcaatagaatgttgtgggagggatggtttaccagttttgagctaggcctcaggaggtctagggcatgtctactctctcttaggacagctgcccccaccctgcaaaaaagcctgggctagcctgctggaggatgagagcccacctggatcagttgtctcagctgatttcagacacgtgagagagagctcagcgagactcagcttgtagctgactacagatgtgtgagggaacctggctgagaccaaaacaactgtccagctgagcccaggctaaactgccaacatgcagaattgtgagctaaataaaggctgctgttctaagtcactgggttttggtatggtttgttaggcagccataactaacaggtgtaattggtccttattcccttattcactgagagtgatgggttctcagccctgagctggacttggaggccatggaaatgcagtggacatggcctttgttccttaccttgaaggtgtggaaggaggtcaagttcatggaataatggagaacacacagctgtaatcgtttgcttgttcagggaacacacatttattgagcacttgctatgtgccaggcacagtgccaggcagtagggatccagatatttaaagaaaacaaacaaaaatcaggtccaaaactcctggggagaatgctgagagtggtatcagcttttaggaattcagacacaaaatctggattgaaaaatggacagatgtgaagacagaaaaagacaccagatgtggagtgtcagtggagggtctgggggcccaggctcctgcgctctggctggctcagcttgtactatcatgtgggtgactggcctgctcttctgtcccacacacatgggtggaaattgcaactgcagatgggcagcttgaggtttacgaacatcagggagactgtaagccggccatgagggaagcagctgtagaaaggtgggcatggaaccaaggtggccaggcccaagccagcaggcacccccccaccttggggatcctgaccactgcagagaccagctccagactgtgaaggtgcctggctgaccgacacaatggaggaagaggggtgagggccaggcttagggtgggggatagggttcccgtgtgagatccaggccgtgtttttaaaaaaaatttttgagacagagtctcactctgtcatccaggatggagggccatggcacgatcgcagctcactgcaacctccacctcctgggtgcaagtgattctcctgcctcagcctcccaagtatctgggattacaagcgcccaccaccatgcccagctaatttttgtatttctagtagagacagggtttcatcatgctggccaggctggtctggaactcctgacctcaactgatccacccacctcagcctcccaaagtgctgggattacaggcatgagccactgcacccagccccaggccatctttttcactccctcctctcttccatcccctaaatctataagacagaaatgatgggcccttgatggtatgcaagccccatttgtttggcattgatgccctgattcttggagagctgagatgggagtgtagaagaatgggcagactctctctgggaaagcctactgtcctcgaagggaaatcatccattccatgagcacatgttactgaagacctactccaagccaggccctctgcaccagactccacggagctcttggaccaaagggaaaacaagtaagcaggggattgcagaacaagctgggggtgccaggattggggtgggcatggggagcaatgcccacctcctggaggatgagggaagctttcctgaggactgctgggggtctgacatctcatctgagacttgaagatgaggaggagttaggagggccggtggggccatgcagagcctcccaggttgaggtctggagaaaagcagcatatgtctatgcaagctccttgtccacctgccttgcccatctctgctgaaggctctttatcatttgtccctgcagcccaaaaacctgggtgttgaattatcatattccacatcccacacccaatctgttggcactaccttcacaatgcatctagattctgtatttataaaatgcttccatcaaatgtttacatggaaaaaaaaaaagagag

SEQ ID NO: 1245 - DNA, 451 bp, Homo sapiens; identical to SEQ ID NO: 649

SEQ ID NO: 1246 - DNA, 4635 bp, Homo sapiens
atggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttacccacacctagtccagaagtgcccaagtccaaacccgctctggaacctgccacgatacaaccggagcccttggtgcccacaactgcctcaaaaccatctgagagacctaaaaccacacacagaccagatgcacctcaaattcagcctgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggttcctgctacaatctttgaaccagtttctcctataaaagaggctccagggacaacattcgttcctgttacagacctcgagcctgttacttttagaactgagatccctgcaacaaccttagctaccaaaacatcaaaaagaacccgccctccacgtcccagacctaaaactacaccgagccctcaggcacctgagaccaaacctgttcctgctacagtcctagaacctgtcactcttagacctgaggcctcaacaacattagcttccaaaacatcacaacggacacgtcgtccacgtctcagaacaaaaaccacaccacgtcctgaagcacctgaatccaaaccagttcctactgcggagctcaaacctgttacactcagaactgagacttgggtgacaacacaagctcctaaaacatcacaacgaactcgtcgtccacgtcccaaaactaaaaccacaccaagtcctgaggttcctcaaaccaaactggtttctgatgttctggaatcggttacacttagtactgagtcaccaaaggagaccatagcaccagccaaaacagactatgtatatcccactgccaaagcaccactctggccagaggagccaaagactgaagttgtggaatctattacatatgtatctgaaccacctgagaccacactagaaacgtcgcctctgccttctcaatctataaccctacccagcccagatgagcctcagactgaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagttttttttt

SEQ ID NO: 1247 - DNA, 416 bp, Homo sapiens
caaatggacctgtcttgtggttcaagggaacagggccaaaccggaaattaatctacaatttcaaacaagagcagaatccaagacctcccaagaacagacctgcaggcagagcaggctccagggcccaccatgatgcccatacctgcctctcggccctgcctgagagaaacagcacaaactatttcgtccaaccctgctgctgcctccggctgctgggactcacaggcttgctgtcaaaataatccaaacagggaaggaacgtacaagtaaataacaaaagcccccatactcttctgactccctggagacagctactttttaggagtttcatttgccttcttcaagagagctttcttccactgacataaaatgccagcttgatcgtacaataaatctgtctatttacctgggtccaa

SEQ ID NO: 1248 - DNA, 1953 bp, Homo sapiens
cgaggtcctcctcccagggcccggggctggggagcggaagccatcagtgggctcggaggacactgtcccagccaggacacggccatcggtcactaatctgcagcaccggaatgtccccaggccaatcagcgggcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccacctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctgtggtttgcagaggggcagcggtacagccacgcggcaggagagtgtgctcgcaacgccacctgcacccactacacgcagctcgtgtgggccacctcaagccagctgggctgtgggcggcacctgtgctctgcaggccagacagcgatagaagcctttgtctgtgcctactcccccagaggcaactgggaggtcaacgggaagacaatcatcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacggggtattaaattatgaatcagctg

SEQ ID NO: 1249 - DNA, 949 bp, Homo sapiens
gtgtacgtgtgtgagcactgccagggctggcgaagaaccagccgccgcctttagtccgagccgccgggccacccaacacaagggcaggtctcgctgccggagaagcctgggctccgaaccagcctgcacgcggctcagtgtgctccgccgcctgggaactcgcacccgaggagcgcagggggcaaggagcccctcaccctccctctcgtccgcccgcccgcctccccagctgcggaccgcgcgcttgctggtctcaggcgctggatttactcgcttttcaatttttcgtaccctccctcccttttttttttggtcccccactccccgctacgaccccctttccccgcttgattgtcaagcctaaccttgcccgcgtagtcatgggatgtctaattttatttgcatctaggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactgggaaaattgtagatc

SEQ ID NO: 1250 - DNA, 3718 bp, Homo sapiens
cgattgctcatcgctgggcctggaagatcacacagagggtttggcttggagtgactcctccaagcagggtctgcaccgccctgtgggctcaaggagggagaggagctgtggagaaatgctttgatgtctcttgcagatgaaacagtggagggggagtgggcaagactgggccaccatgggccacttgtctctgaggtgtgcaaagaggtgccagagggccacttggcagcggggctggttgggggccctgcatggagtcccctgtgtctgttgtctcacgagtcggtgtccaccagagaccctgcatgatccgcagcagtcctggcccgttagacctttctgtgtaaaagaaatgttctattgtgttctgtccaagacagttaccactggccgcatgtggcccccaaggcttgggatgtggctcttgccactgaggcctggatgtgggcgtttcatcgcatttgaatgagtctgaacctgtctttgaagagcctagggccagtgtgtgccacattcaactgtgcagggcagtgtccgctcatggttgggttcagaggatctgactgcgggtgccacacatgtgctagctcacgcgagtctcacgacagccttgctccatggaagaggaagtggagcctcgggaagggtgacagcagtggggtctttagctggagtggcccaagcccattgcggatggagggatggatttggccatttgtcaaacagctaccgagcacccactgtacatgtggctttgtgctgggacattgaggagggcaggagaaggaaggcagacaaacacccgggccgggctccagcaagccctgggttccgggctatgtcaggtgctcagggctgaacctggcatgtcttgcagcctctggctcccaatctgagaagggtggaccctgggctcccatgcgatgcagcggtagggggggtgccctttgccagcaggtgggagccgtctgtctgcagagctcagtccctgtagaggtggtggagctgcctgtgggaggccagggaggcgaggaaggaagccaagcccacagccctgggaaagcccaaggagtcggttggagattattttgggcatctctaccaccaaattgccggcttcctctgctagtctttcccctggagaaccgttttgagcagaagcaaaaccacagggcaaggagaagcttagaggagcacattaactctctgtggacccaggaacagcctgcgggcacctgcgtcctgctcctgtgggcctgactgctgcaaagcccctggcggggtggagggagctaagcgtcatcggggtggccctcagggcacctctgttctagtggatgacaggatggtggggaagctggtgcgtatgtggtgtagagacgttcgtattctagttccagaacccctccctcttccccagcccccttttttcttcctcccccaagtacttcccagagcccccctttctgtttccttcctggacaggcactcactgttgtaccgatgaggttgtaacagaaacactgggaagcctcacagcagccggagggggcaccacaaggagccttcctgtttccaccattagccaagcaaatgaagcagaatactgaactgcctgagtgccactgtcatggaaaacacgcccaggaaaatcccctctgcacacccagcaggggtttgccttggggggtccaggaccccatatatctgtcttcctttctgttgtcctgctccgtattttaggagcttcccacagtggccccatagtatgtttactcacagtcacgttaggaaccatggcgctgtgctgtgtacatacctcaggtgccgtttggcttagatatcgttgtaggcactgcagagggaactctaattaaagatagagatgtccaagcatggctgtcgtgcagaggggactaagggtgctgtgtgtggtcagcgttcccaggcagtggtaggaagcctgggggcctgacactgactgagcccccccactgctcccccaggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagagggagccccctcctcagcacagacctgtcctgcttggtggggccctgatgagctcatgcagggtgagcccttcgcctgcctgacccaccaggagcctctgcccaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacatactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccactgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttgcactgg

SEQ ID NO: 1251 - DNA, 882 bp, Homo sapiens
atgtcctctggcggcggctcccggggcctcctggcgtggcttctgctccttcagccctggcccgggcagaactgggcgggcatggcggcgccacgcctcccgtcccctctcctctcagaggagggcggcgagaaccccgaagcgagcccggctccaggacctgaagcgggccccccactcaatctgtttacgtcctttccaggtgactcactgctgtgtggccgaacccctctgagaatcgtgggaggagtggacgcggaggaagggaggtggccctggcaggtgagcgtgaggaccaaaggcaggcacatctgcggcggcaccctggtcaccgccacgtgggtgctgacggcaggccactgcatttccagccgtttccattacagtgtcaagatgggagatcggagtgtctataatgaaaacacaagtgtggtggtctcagtccaaagagcttttgtccaccctaagttctcaacagttacaaccattcgaaatgaccttgcccttctccagctccaacatcctgtgaattttacctcaaacatccagcctatctgcatccctcaggagaatttccaggtggaaggtaggaccaggtgctgggtgaccggatggggcaaaacaccagaacgagagaaacttgcatcagaaattcttcaggatgtggaccaatacatcatgtgctatgaggaatgtaataagataatacagaaggccttgtcatctactaaggatgtaataataaaagggatggtctgtggctataaagaacaaggaaaggattcttgtcaaggagattctgggggccgcttggcctgtgaatataatgacacatgggtccaggtagggattgtgagctggggcatcggctgtggtcgctga

SEQ ID NO: 1252 - DNA, 4464 bp, Homo sapiens
ttgcacgccggggtccttgcccgctccctctctctgccaccgctcaaagcctgggagaacgcttttgaaagcgaatcaggaaattacttatcaatctgaagccccaaagaattatgaataatcctcgctgccaaagggaaggggattttgagcaaaagctccacatctgcgcacactagagttcaaagactccagctgttggaaggtcttgtgagcaatagccaaagatgtttgtcttgctctatgttacaagttttgccatttgtgccagtggacaaccccggggtaatcagttgaaaggagagaactactcccccaggtatatctgcagcattcctggcttgcctggacctccagggccccctggagcaaatggttcccctgggccccatggtcgcatcggccttccaggaagagatggtagagacggcaggaaaggagagaaaggtgaaaagggaactgcaggtttgagaggtaagactggaccgctaggtcttgccggtgagaaaggggaccaaggagagactgggaagaaaggacccataggaccagagggagagaaaggagaagtaggtccaattggtcctcctggaccaaagggagacagaggagaacaaggggacccggggctgcctggagtttgcagatgtggaagcatcgtgctcaaatccgccttttctgttggcatcacaaccagctacccagaagaaagactacctattatatttaacaaggtcctcttcaacgagggagagcactacaaccctgccacagggaagttcatctgtgctttcccagggatctattacttttcttatgatatcacattggctaataagcatctggcaatcggactggtacacaatgggcaataccggataaagaccttcgacgccaacacaggaaaccatgatgtggcttcggggtccacagtcatctatctgcagccagaagatgaagtctggctggagattttcttcacagaccagaatggcctcttctcagacccaggttgggcagacagcttattctccgggtttctcttatacgttgacacagattacctagattccatatcagaagatgatgaattgtgatcaggaccaagatccctgtggtaaacactctgattgaatctggggttccagaaggtggaacaagcaggaatgggatccaaagagactcccactcagattctaaagcatttaaagacaattctagcagaatttatcaaaacaagatgaaacacagaaaagttgaaaccacaacaaaatgaattctattaaagaatagccccagatataaattctcttgaaagcaatgttcataaatatttaagcaaattaaagacaatgttaacaaattttctattaaatgccctgagtgataaaaccagttggcaataatattgccttattaaatcttcaaaaaatatattttagtctgttatttaagaaaaacataacatcccaaaatctttgacaattctcgaaaggctatatagtaagtcaaaaaccaaaggtaagagatgctaactatttttcaagcaagctacagagaaatgataaatgttttttgttttattatttattccttcatgtttgtatatattcactcaacaaccctttaatgagcctgtaaggaccagacactgtggcgctgaatcagatttaataatgagttaagacaaagcccctacctatgggctagtgtgtggtgatcaaactatcacaattcagtgtgatgagcagcatagcaaacagatggatttgaagctaaaagcacacagggtctgctattcctgaggctgggggccagagaagcttttacgcatggaaaaacactaatcatgccaaggtgtatgtgtttaagggggtgtgatggatgcaaagggaatgaggaattcagcactgcattctctttgcaccctcaatgcatgattggtattctcaacagcaaaggggtgaaaaatctagagacagaggaggcctggcaggggtgataaaaatggagattgaaatgaagagaaatagccagcaggtgattcttctgaatcctttagtgtgatggtttcccaagacaaacatttgtcctaatagctttctcataaatatgggcaccactttacattgtggtaagacattgcttctcatggatctgctaggtatttatttcaaataaagcaaggcatatgttcactgatttacgagtaagctgatgagagcaatgaacaggagaaggagggagagagccaaatgtctgagtaaacagatatcccttccaagtctcacacctcccttagtcccactcttgcttgtgtcagcaccttgttcttcactgaactgcaattcttcaattattctcttccatgattttgtctgatctaccatttctatggtttatggtaatagtattccctttatccctcccttttggtaacttccaatcctccttctatgtattcctttctctgctcattgacttataaatagttttcatacctcttatgtttgaatcaccatgctagattctgtgaagacagaagagtatcaagattaatatattaatagtatagctctgactggtaaatttcttttttttaatcttccccaatttaaattttttaatttaaaagtaaattttactgtcgaaaatgcaaacttggggagggcggaaacatcacacacaaggtttccacttcacacttggagggttgcatggcggctgggcaaaggtgctccccacttcccagatggtgcggcggctggccagaggcactcttcacttcccagacagaggggcggccgggcagaggtgctcctcacttcccagagggtgcaggagccagctctgactagtaaatttctaaggataccagaaaggaaatggcatgcacacacacaaaaaatacctaaattttggatgagaaaatgataaaatatgctaagttctaggctggaaataagggcaaaatgctgtgaaagaagaggaaatgtttacttccaaattaggatgtgacagagaagggatagggaaatcctctctgctcattgggccttacatgatgggtgacacttggagtggcacaagttgggggaaagcgcacttgagacagaggtaatgatggggacgaagtgagaacagagacccagaaggagaatcaatggaccatatttgtaagagctttgaaagccagcctgagaattggaggatttattcataagaaagtgtagagaccctgtgtatttcagagctggatactgccattaccacagatgaaagttgcaatgatctagcagttgtgtgcaaaggcaaggcttgcttttcctgtctttcaaccctatcttgcttttcctgtctttcaaccctatcttgctttcattgtcttcatcttcctgccatactttgtgcacttattgctctccttctgagtcaggacatgtgtacaggagaccaagaacaatgagtattagaaaaaaaggagacagcaaaggtggtttgaggtagtcacctgcttacagataacagccaaagatagaattccaagttataaagcataaaaaagagccaacagaagtaactaatccgggaaaagtgaacatatgggccctttaaagactacaagatttgctagataaactggaaatggagaagttattgcagacagtcatgaaccacaaatcactgtgattaaaattttcttctgatcgtaatccacgaatgcattcattttttggacattgcttacttatcttttaaatgtttcttttattacaaagcctattttgagtagcttttaaaactgaatttcctttaattggtttgaagcctagagatgaatttcgttttcaaatatctggtgggatggtaatggggattagagaactgacatgagaaaagaggagctgttttggtattaaacgaataaaatcttaagcaaatataggtgtcttttattcttaaaaaatagcagatacagtttatccacatttgtaaatatttgtataaagaaagtagcaaaacagttttggtttaaaaagttccaagtctcattgcaatcattctttgtaaaggctgacttgtaatgaatatgtattaagcaatatttattgactatacaccatcttgttctagaagagtttaaagccacttaagaagataaataagatataaaaagaaaacagcagtcaaaagcagatgagaagaaatgggaaaaacaaaaaaaaaagaaaataatgaggctaatataatgctgtgtgtacatgaacatgaatgtgcctgtgttacacattttcaggccacaaatgtttctttgtgcccctgcatgcacaagggtatttccaggtcatttatcattgtgaacagtgttgcttatgataaaaaatagattctataaactctaaatatactttttttctaccactctgtgtaaaagatcatgaacgtaaataaattttagatatg

SEQ ID NO: 1253 - DNA, 3968 bp, Homo sapiens; identical to SEQ ID NO: 1078

SEQ ID NO: 1254 - DNA, 1289 bp, Homo sapiens
cggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtcgtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 1255 - DNA, 1447 bp, Homo sapiens
gcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcc

SEQ ID NO: 1256 - DNA, 1172 bp, Homo sapiens
agctcctaaccgcgagtgatccgccagccttggcctcccaaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcctggccgccaccccgtctgggaagtgaggagcgtctctgcctggccgcccatcgtctgggatacgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggcaaaatgaagctgaatctggtgcagatctttttcatgttgctgatgctgctgctgggcctggggatgggcctggggttgggacttcatatggctacagcagtcttggaggagagtgatcaaccgctcaatgaattttggtccagtgactcacaggacaaagctgaggccactgaggagggagacggcacccaaaccacagaaacgctggtgcttagcaacaaagaagtggtgcaacctggctggccagaagatcccatcctcggtgaagatgaggttgggggtaacaagatgctcagagcctcagctctctttcagagcaacaaagactatcttaggcttgaccagacagatagagaatgcaatgatatgatggcacacaagatgaaggagcccagtcagagttgcatagcccagtatgcattcatccatgaggatctaaacacagtcaaagctgtctgtaacagtcctgtcattgcctgtgagctcaaggggggaaaatgtcacaaaagctcccgaccttttgatttgacattgtgcgagctgtcccaaccagaccaggtcactcctaactgcaattacctaacttctgttataaaaaagcacattattataacctgtaatgacatgaagcgccagttaccaactggacaatgaagcaactcatcatcttttttctcttcaccttct

SEQ ID NO: 1257 - DNA, 3121 bp, Homo sapiens
gcgagccacggcgccgggggcggccaaggggaggcgggatgagtctgcgagccggctgagcgcgccgaggagccggccggggcaccgccggggacatggcgtcttggctccggagaaagctgcgtggcaagaggcggccagtgatagcgttctgcctcttgatgatcctatctgcgatggctgtcacccgctttcccccacagcgtccatccgccggcccagaccctggtcccatggagcctcagggggtaactggcgcccctgcaacccatatccggcaggctttgagctccagccggaggcagcgggcaagaaacatgggcttctggagaagccgtgctttgcccaggaactccatcttggtctgtgctgaggagcaaggccatagagcaagagtggacagaagcagggagtccccaggaggggacctcaggcatccagggagggtgaggagggacattactttgtcaggacatccaagactcagtactcagcatgttgtgctcctgagggaggatgaggttggagatccaggaaccaaagacctgggccacccccagcatggcagtcccatccaggagacacagagtgaggtggtcaccctggtcagtccactcccagggagtgacatggcagctttaccggcttggagagctacttctgggctgacactctggccccatacagcagaaggcagggatctgctgggagctgagaacagagccttgactggtgggcaacaagcagaggatcccaccttggcctcaggagctcatcagtggcctggctctgttgagaagctgcaagggtcagtatggtgtgatgctgagacgctgttgagcagctcgaggactggtgggcaggctcccccatggctgacagaccacgatgtgcagatgctccgtctgttggcacagggggaggtggtggacaaagccagggtccccgcccatgggcaggtgctacaggttggcttctccactgaggctgcccttcaggacctgtcctctcccaggctcagccaactctgttcccaagggctctgtggcctgatcaagaggcctggggacctgcctgaggtcctgtccttccacgtagatcgtgtgctggggctgcgccggagcctacctgctgtggcccgccgcttccatagccccctcctgccctaccgatacacagacggtggagcaaggcctgtcatctggtgggcacccgatgtgcagcacctgagcgacccagatgaggatcagaactctctggccttgggctggctgcagtatcaggccctgctggcacacagctgcaactggccaggccaggccccgtgcccgggcatccaccataccgagtgggcacgcctggcgctcttcgacttcctgttgcaggtccacgaccgcttggatcgctactgctgtggcttcgagcctgagccctcagacccctgtgtggaagagaggctccgagagaaatgccagaacccagccgagctgcggctggtccacatcctggtccggagcagcgatccatctcacctggtctacatcgataacgctggcaaccttcagcaccctgaggacaagctgaactttcggctgctggagggcatagatgggtttcctgagtctgccgtgaaggttctcgcatcagggtgtctacagaacatgctgctgaagtcgctgcagatggacccagtgttctgggaaagccaaggcggagcccaggggctgaagcaggtcctccagaccctggagcagcgaggacaggtgctgctgggacacatccaaaagcacaacctcacactcttcagggacgaggacccataagccgcacacagccctgagtcaatgagcatccatcctgatggccacattttcttgggctcactcatcttgaggacaaatgggaaaagccagaagccagaggggcacaaggatgtcacgggatatttcacctgcctgggatggtggaggtagtatggggttttcaatctcaaagcgtccctttctgccttctcggctctggctatttattcccttgcaccaacaaatacattcgaaaatgttctgtgagctgctcaagaaactgtaaaaatgtgtgatgcacgtgcatatgcagagtgggagaactttgtgtgtgtgtagaggtgtgtaggtgtgggtggcatgtgtgcccgcctgcatgcaatacctgagaccaacctaataaaggtacaatcttcatagaactgcacttgcagcctggagttgctctggctgaaagtagactcaggcttaagaaatgaaacataatgcgtttgtctttatagactttaaattttcaattattactcagttatgtttttggtttaaaaaattataaaagtctaaaagtaatacatgctcagtaaaaacaagtccataaaaaatagaagcatatgacaaaaagcataagtcccacaaactccctagcggtgtgtatgtgtgtgtgtgttattcatggtcacactacatgcaaattaaaaaatgaaagtgtggtcatgctttgtcaactcactatatttttactttattaactatattctgtatcagccatctgaattgacccaatctttattggtgactgcatgaaattccaaggcagggatgtgtcatattttctttagctggtcccataatcatgaacatttaagtagctccaatttttcatcaattacagacattgccgccatgaacatgattgcatggcgtgcaagtatttctgcgaggtagatttccgtacgggatttctggggcaaagggtatgggcattcagtattctgagagaaactgccaaattgctctctgaaatggtggtgtcaatttacatttctcccaagagggtaggagactgattatttttctacaccttcaccaacacttggcattctcagacttttgggttttttttggcctatttaggaggaaaaccgattttaaaagctgcatttccttaatcatgaatgaagtcatctttccacttatttgccagacatttgtattttcttttctgcattgtctttttgttttaagatgtttgccctttgcttgttaatttgttggaaatctttgactctaataagtgtgatcaatcttttctctgctga

SEQ ID NO: 1258 - DNA, 911 bp, Homo sapiens
ccccaaacctgccaccgacggccacttccgtttccccgatagtatttggggatctcgaagcgatacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaaggtaaggggttaaaatctcataaaacaggattaggactcaccaagtcttctggtgttacagggtgaaagaggctcgtgtgatgtcaccagagggatgtggctaagagctgtgatgtcacctgagggaggcaggatgggttctgggctactcaaaagagaggtttctgagtttgcactggataaagggggcagagggtcatacgtggagggaaaagagccttagagactcccctttgacacagggaatgaaagaacacgttctcccccaccccattactatcaactttgcttttctccctggacttcccttctgtccttctttttccctccccccatcacagaggcctgt

SEQ ID NO: 1259 - DNA, 761 bp, Homo sapiens; identical to SEQ ID NO: 929

SEQ ID NO: 1260 - DNA, 2881 bp, Homo sapiens; identical to SEQ ID NO: 811

SEQ ID NO: 1261 - DNA, 3971 bp, Homo sapiens; identical to SEQ ID NO: 1079

SEQ ID NO: 1262 - DNA, 730 bp, Homo sapiens; identical to SEQ ID NO: 1166

SEQ ID NO: 1263 - DNA, 485 bp, Homo sapiens
ggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggt

SEQ ID NO: 1264 - DNA, 1803 bp, Homo sapiens
ctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctgggctttccagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacagg

SEQ ID NO: 1265 - DNA, 2331 bp, Homo sapiens
gctgatcaggtgtgtctcctcctctgtcccctcccttcttctcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttacggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacgcggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctatcctctcttcctcttcccccaagattgagctctctgcccttgatcagccccaccctggcctagaccagcagacagagccaggagaagctcagctgcattccgcagcccccacccccaaggttctccaacatcacagcccagcccgcccactgggtaataaaagtggtttgtgg

SEQ ID NO: 1266 - DNA, 922 bp, Homo sapiens
tctctgctgatctgagtctgcctgtggcatggacctgcatcttccctgaagcatctccagggctgaaaaatcactgaccatggcaccatggtctcatccatctgcacagctgcagccagtgggaggagacgccgtgagccctgccctcatggttctgctctgcctcgggctgagtctgggccccaggacccacgtgcaggcagggaacctctccaaagccaccctctgggctgagccaggctctgtgatcagccgggggaactctgtgaccatccggtgtcaggggaccctggaggcccaggaataccgtctggttaaagagggaagcccagaaccctgggacacacagaacccactggagcccaagaacaaggccagattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcatatcctgcaggtatggtcagaacccagtgacctcctggagattccggtctcaggtgaggaagccacagtcttctctagtacaattcagggaagccagacaggttgtggagagctttacaggcagggcagcccctgctaagaaagacaaaaaggggaaggagaacacagaaatcctagggacaca

SEQ ID NO: 1267 - DNA, 1439 bp, Homo sapiens
atgtgtacaaagacaatcccagtcctctggggatgtttcctcctgtggaatctctatgtctcatcctctcagaccatttaccctggaatcaaggcaaggattactcagagggcacttgactatggtgttcaagctggaatgaagatgattgagcaaatgctaaaagaaaagaaactcccagatttaagcggttctgagtctcttgaatttctaaaagttgattatgtaaactacaatttttcaaatataaaaatcagtgccttttcatttccaaatacctcattggcttttgtgcctggagtgggaatcaaagcgctaaccaaccatggcactgccaacatcagcacagactgggggttcgagtctccacttttaggttgaagaatggtagtcagcttaagcctgagcccaactggaaggcctttgcaccctcgtgtagaaggaggaaatcagattcaagccaagacacaggaggggctgatctgtttctctccggagtctactttaccggtatcattatcctaacccgaaatgactttggtcatcctaccctgaagctccaagattgctacgcccaactgagccatgcccacgtctcattttccggagaactcagtgttctgtataactcctttgctgagcccatggagaaacccattttaaagaacttaaatgaaatgctctgtcccattattgcaagtgaagtcaaagcgctaaatgccaacctcagcacactggaggttttaaccaagattgacaactacactctgctggattactccctaatcagttctccagaaattactgagaactaccttgacctgaacttgaagggtgtattctacccactggaaaacctcaccgacccccccttctcaccagttccttttgtgctcccagaacgcagcaactccatgctctacattggaatcgccgagtatttctttaaatctgcgtcctttgctcatttcacagctggggttttcaatgtcactctctccaccgaagagatttccaaccattttgttcaaaactctcaaggccttggcaacgtgctctcccgggttgctagtaccagtgttggcctggttattttgggacaaagactggtctgctccttgtctctgaacagattccgccttgctttgccagagtccaatcgcagcaacattgaggtcttgaggtttgaaaatattctatcgtccattcttcactttggagtcctcccactggccaatgcaaaattgcagcaaggatttcctctgtccaatccacacaaattcttattcgtcaattcagatattgaagttcttgagggtttccttttgatttccaccgacctgaagtatgaaacatcctcaaagcagcagccaagtttccacgtatgggaaggtctgaacctgataagcagacagtggagggggaagtcagccccttga

SEQ ID NO: 1268 - DNA, 1005 bp, Homo sapiens
agctagtggaaaaacaagagaagggaagtcaaaaggctacttgctgtcagctaaagccagacaacctctcctgtttcatctcctggcaacagaatgcatcctccttttgggaaactgcctctttccccactcctcagagtaaatcttgctgctgctcactctttgggtctgcactgcccataagagctgtagcactcaccgcgaaggtctgcagcttcactcttgaaaccagagagaccacgaacctaccgggagaaatgaacaaattccggacgcaccatctttaagaactgtaacactcactgcgaggatctgcggcttcattctttaagtctgtgagaccaagaacccaccaattccggcacactaatatgctgttggaaactggctatatggaaaggctatgtggaagaaaacaaacaccccagccaacataatggagctcccagctgacagctgacatctagctgattgccaaccactttggaaactgatcttcaaaacccacttgagctatgtcaagagaagccacctgtgacacagaagcagaaggatccaagtcaaaggagtttatttgggaggaaatagcacgagagaatgtgatacttgggaaaattatgtagagagagagattaaagatgcaagctataaaaggaattgataatataaaagctcctgagaagattggaagaatacatataagagaccctgatccttgataggatggaccttttctagaactaccatcaccctggaagctgaagaaaatcattcgtaactgaggcacacttgccttttgcaactaagctctactgaattccaaagctatagaaatatccatcttgacctggaaagtctgtttctttgctagtccagaaggttttttttaacatgaacaagatcctctcaagcactgtttgctttggactcctaactttgttatccgtgttgagttttttacaatctgtgcatggacgaccatatcttacccaaggaaatgaaata

SEQ ID NO: 1269 - DNA, 761 bp, Homo sapiens; identical to SEQ ID NO: 929

SEQ ID NO: 1270 - DNA, 946 bp, Homo sapiens
ctagagactcatacagtgacctagagcaggcatgggtgggtcacaggctttggagagcactctctgtcctgatcttttcagttgagagacttcagctgttcattgctcatttggacttagttcaaggtcatgtcaaagaagaaggtgcacttacgctagttgttagctctgtcttttgtaaccatcaagttccatgcgattgatcagatttaggagggggcgttgggggataatcgtaagtgaaggacagtttgcaaccttaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaa

SEQ ID NO: 1271 - DNA, 609 bp, Homo sapiens
atctcagcaaccgctgggcatccggaggatgtggggacgcggagctgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggagtagagacagggttttgccctgttggccaagctggtcttgaactcctgacctcaagtgatccacccgcctcggcctcccaaagtgttgggattacaggcgtgagccatcgtgcccagccagattctccatttctaacaagttcccaggtgatgtcgatgaagctggttcgtgaactgcactttaacatgatgtagaaattttacaaactagtagagtaagggggtggctgcaggctggagaggaagtccaggctaaacgcctggcaacttgaggtggtttccgcccccttgctcgctgaggttccctcccaggaatccgacacgtgacggtctgtccgccgtctcagactagaggagcgctgtaaacgccatggctcccaagaagctgtcctgcctt

SEQ ID NO: 1272 - DNA, 1312 bp, Homo sapiens
aacgtcaagcggtggcttcacgaaatcaaccagaactgtgatgatgtgtgccgaatattagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtgg

SEQ ID NO: 1273 - DNA, 950 bp, Homo sapiens; identical to SEQ ID NO: 1126

SEQ ID NO: 1274 - DNA, 1815 bp, Homo sapiens
atggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaccatgccatctcctgaggatctgcggctggtgctgatgccctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttg

SEQ ID NO: 1275 - DNA, 1967 bp, Homo sapiens
tctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctg

SEQ ID NO: 1276 - DNA, 1479 bp, Homo sapiens
tctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaac

SEQ ID NO: 1277 - DNA, 2205 bp, Homo sapiens
aaaacaggaaataggtgtttcatatatacggctctaaccttctctctctgcaccttccttctgtcaatagatgaaacaaatacttcatcctgctctggaaaccactgatccctgttccaccggttttgttttcccagcaatgacattattcccagtgctgttgttcctggttgctgggctgcttccatcttttccagcaaatgaagataaggatcccgcttttactgctttgttaaccacccaaacacaagtgcaaagggagattgtgaataagcacaatgaactgaggagagcagtatctccccctgccagaaacatgctgaagatggaatggaacaaagaggctgcagcaaatgcccaaaagtgggcaaaccagtgcaattacagacacagtaacccaaaggatcgaatgacaagtctaaaatgtggtgagaatctctacatgtcaagtgcctccagctcatggtcacaagcaatccaaagctggtttgatgagtacaatgattttgactttggtgtagggccaaagactcccaacgcagtggttggacattatacacaggttgtttggtactcttcatacctcgttggatgtggaaatgcctactgtcccaatcaaaaagttctaaaatactactatgtttgccaatattgtcctgctggtaattgggctaatagactatatgtcccttatgaacaaggagcaccttgtgccagttgcccagataactgtgacgatggactatgcaccaatggttgcaagtacgaagatctctatagtaactgtaaaagtttgaagctcacattaacctgtaaacatcagttggtcagggacagttgcaaggcctcctgcaattgttcaaacagcatttattaaatacgcattacacaccgagtagggctatgtagagaggagtcagattatctacttagatttggcatctacttagatttaacatatactagctgagaaattgtaggcatgtttgatacacatttgatttcaaatgtttttcttctggatctgctttttattttacaaaaatatttttcatacaaatggttaaaaagaaacaaaatctataacaacaactttggatttttatatataaactttgtgatttaaatttactgaatttaattagggtgaaaattttgaaagttgtattctcatatgactaagttcactaaaaccctggattgaaagtgaaaattatgttcctagaacaaaatgtacaaaaagaacaatataattttcacatgaacccttggctgtagttgcctttcctagctccactctaaggctaagcatcttcaaagacgttttcccatatgctgtcttaattcttttcactcattcacccttcttcccaatcatctggctggcatcctcacaattgagttgaagctgttcctcctaaaacaatcctgacttttattttgccaaaatcaatacaatcctttgaattttttatctgcataaattttacagtagaatatgatcaaaccttcatttttaaacctctcttctctttgacaaaacttccttaaaaaagaatacaagataatataggtaaataccctccactcaaggaggtagaactcagtcctctcccttgtgagtcttcactaaaatcagtgactcacttccaaagagtggagtatggaaagggaaacatagtaactttacaggggagaaaaatgacaaatgacgtcttcaccaagtgatcaaaattaacgtcaccagtgataagtcattcagatttgttctagataatctttctaaaaattcataatcccaatctaattatgagctaaaacatccagcaaactcaagttgaaggacattctacaaaatatccctggggtattttagagtattcctcaaaactgtaaaaatcatggaaaataagggaatcctgagaaacaatcacagaccacatgagactaaggagacatgtgagccaaatgcaatgtgcttcttggatcagatcctggaacagaaaaagatcagtaatgaaaaaactgatgaagtctgaatagaatctggagtatttttaacagtagtgttgatttcttaatcttgataaatatagcagggtaatgtaagatgataacgttagagaaactgaaactgggtgagggctatctaggaattctctgtactatcttaccaaattttcggtaagtctaagaaagcaatgc

SEQ ID NO: 1278 - DNA, 573 bp, Homo sapiens
ctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcagggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacag

SEQ ID NO: 1279 - DNA, 726 bp, Homo sapiens
atgggggccgtcatgggcaccttctcatctctgcaaaccaaacaaaggcgaccctcgaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagccctgccttgtttggaaggttctccctgtgtggaattcctgcccccatcacctgccctccttttctgccttgtagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaa

SEQ ID NO: 1280 - DNA, 799 bp, Homo sapiens; identical to SEQ ID NO: 1175

SEQ ID NO: 1281 - DNA, 777 bp, Homo sapiens
gtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagtgcacatctctcaccaggaggctcgaggaccctcatttaagatctgcgtgggctttttagggcctagatgggccaggggatgttccactgggaattagaaataccatctgccgtatgcagcaagggatctgcagactttttttctgccattctggtgagaaaaagcgtgacattagctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagaca

SEQ ID NO: 1282 - DNA, 950 bp, Homo sapiens
ggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggccataagatgttttattgaaagaaactttcaatatcaagtaatccaaccaaccttctaagataagccttttccttcaacacaaagaagtgcattttgccaaatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttgg

SEQ ID NO: 1283 - DNA, 2904 bp, Homo sapiens
cttagccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacgatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaagaaatgccttcagatgctgttgtcagtgcggagtcagaggtggcggtgtcctctggggtgcgggaggacagattccagagtcttaaccaacctgctcccacagcccgagcagacagccttttgtctccagggctcctgccaccaacaggccccgctgcgactgagatgtgactcaagcagtcaacagagcagtgggactcttttcgtctggcagagaagattgcacactcgggctgcaggaagctgactcaacaactccctctgacccagtgcaggcctgtacggacagggacagggattgggattaacaccagcccaggcccccaccacaccccatcatcatccaggagcacatgtcgcccacagacttcggctgcctttgaagtcagggttgtgaggggtcgagtcacttgggctttttgcgtctctcccaggttacggttaatacctccctttgctaagcgagagccagcaaattagaagcaattttgctggaatatcaactccagaggcccagaagcagtctgagttcagcgaaaggagagaaggcagttcctagatgggaggcactgtggtgtccttcatggggcgacgttaggggcgatggacttaggagccaatcccaggaagagtacagagcgcagacagagcctcagaagacaaaagtgcttctggagcaggcacatgtggggttggaggcacaggggtgccctggaggagcggctcaccagggaggaaacgatggtgatgccagtcctgcctctgcaccaggaactttctacgtgtattccattccttttttgtttttgtaaactttccttcttagagccattttaggttcacagcaaaactgagtgaaaaggtcagagttcctgtgtgccccctgccagcccccagcttcccatctgttgctgtcaatgaaccagtatcggtgctcacatgaggcttcagtttgctgttggacgttcagtgggtttggacaaaaatgtgtaatgatggatccactgcaggatcatacacacttcactctttagacttgctatggaaaattgcaaacatctccaggagacagactagcatacaatcggcccttcatatccatgggggttccatgtccacagattcaaccaaccacagattggaaatacttgg

SEQ ID NO: 1284 - DNA, 4299 bp, Homo sapiens; identical to SEQ ID NO: 841

SEQ ID NO: 1285 - DNA, 485 bp, Homo sapiens; identical to SEQ ID NO: 1263

SEQ ID NO: 1286 - DNA, 507 bp, Homo sapiens
gatgaagacagatatacgacgtgctggcccaagacatggttagcaaaagactgtcctgctctccgaattatatctgtggagtatgacaccagcctcagcgactggagagcaaggtgccctatggaaagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaagggtaatactttttgtcataaaggaaattggggttatattaacatcagttacacagagaagaagaaaaagtttcttccttgaatgtattatctcatttta

SEQ ID NO: 1287 - DNA, 1771 bp, Homo sapiens
ataagccaggcccaccattccaactctttctcctttttggcttgtaggccgcacctactctgcatatgccccgcccctcactccaggtgtcgcccacttaactgaagatccaggatcccctccttaaggtgcccctggccggcagcgccgccgtggtcccggagcgcggcgacatgccggagctggtggtgaccgcgctgctggcgccgtcgcgcctgtcgctgaagctgctgcgcgccttcatgtggagcctggtgttctcggtggcgctggtggccgcggcggtctacggctgcatagcgctcacgcacgtgctgtgccggccccggcgcggctgctgcgggcgccgtcggagcgcgtcccccgcctgcctgagcgacccctcgctgggtgagcacggtttcctgaacctcaagagctcgggcctgcgtctgcactatgtctcggctggacgaggtaacggacccctcatgctgtttctgcacggcttccctgagaactggttctcctggcgttaccagctccgggagttccagagccgcttccatgttgtggctgtggacttgcgaggctatggcccctcggatgcacctcgggatgtggactgctacacaatcgacctgctgctggtggacatcaaagatgtcatcctaggcctgggttactcgaagtgcatccttgtggcccatgactggggtgccctccttgcctggcatttctccatctactacccatccctggtcgagcggatggttgtggtcagtggtgcccccatgtcggtgtaccaagactattccctgcaccacatcagccagttcttccgttcccactacatgttcctgttccagctgccctggctgcccgagaagctgctgtctatgtctgactttcagattctgaagaccaccctcacccaccgcaagacaggcatcccatgcttgacccccagcgagctcgaggccttcctttataacttctcacagcctggtggcctcactgggcccctcaactactaccgaaacctcttcaggaacttccccctggaaccccaggagctgaccacacccacattgctgctgtggggggagaaggacacttacttggagctggggctggtggaagccatcggcagccgctttgtgccgggccgcttggaggcccacatcctgccaggcatagggcattggatcccacagagcaacccccaggagatgcaccagtacatgtgggccttcttgcaagacctgctggactagtggtccttgctggcctgcccaggaggcatggatactcaggaaggaacacacacccattatctgtgtgtgcctgggagtccatacaatgtccatacatgggtgaactcttgaatcgctcataggcatgggactcctggatcccacacaagcgcacctatgggtgcctcgggacacaccaacccctatactcacacacaggcatggatgcatgtgtgtgtaacaaacactttgaccctgggaactgggtatacctctcttccagtggagccagatgccgagaccgagtgtcccacctcctcccttcctggggcctcactctgcgctttgccaaagtcgcttctctgccatagctgcacagaccttaaaccctgaccttcctgtccctgccttcgacctcctgcctgggtcttcagctcagtgctactctgaatacaatactgctgaccacatttggctacttcagcttaaatgtatgttaattgaaatgaaatacaatgaaaatgcagtgctcagtc

SEQ ID NO: 1288 - DNA, 950 bp, Homo sapiens; identical to SEQ ID NO: 1126

SEQ ID NO: 1289 - DNA, 785 bp, Homo sapiens
aaggggcggaggctgggcggcgttgctctgcgctctgcggctgacggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaa

SEQ ID NO: 1290 - DNA, 5460 bp, Homo sapiens
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccagctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 1291 - DNA, 817 bp, Homo sapiens
ggctgatcgcagtccggaggtggtccattatggctgacatgcaaaatctggtagaaagattggagagggcagtgggccgcctggaggcagtatctcatacctctgacatgcaccgtgggtatgcagacagtccttcaaaaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcaggg

SEQ ID NO: 1292 - DNA, 580 bp, Homo sapiens
cctgggcctagattccccagctgctgttctctggagggagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttcta

SEQ ID NO: 1293 - DNA, 3829 bp, Homo sapiens
agcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaact

SEQ ID NO: 1294 - DNA, 560 bp, Homo sapiens
gactgctcagtagaagccatggctcgcagacactgcttctcctactggttactggtatgctggttggtggtaactgtggcagaagcactgtccactttctatctccagcagcatattaatttgcacatggacaagaagaggtatttacgcctcctggagattcacaaaataatgcggacgctaccgactgccagatctttacactcacccctccacctgccccgaggagtccggtcacaagggcccagcccatcacaaagacacccaggtgtcccttccatttttttccacgaaggcccagaatccattttaggtttccaaacagacctttcgtcccttcaaggtgtaaccaccgttttccattccagccattttattggccacaccgttaccttacttataggtatttccccagaagaagactccagagaggaagctcatctgaggaaagctgagagggaagagaaacccaaacatactgaagcaaaaaaaagcctatccttcagaaaaaagcaacaaaaagatttctgttttatctttcgaaactaaaactattggat

SEQ ID NO: 1295 - DNA, 1477 bp, Homo sapiens
gcgctggagcgttttccggccgtgcgtttgtggccgtccggcctccctgacatgcagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtcgtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgc

SEQ ID NO: 1296 - DNA, 657 bp, Homo sapiens
atgctgccttgcctcgccctgcttctcctgatggagctgtccgtgtgcactgtggcaggtgatggtggagaggaacagacactcagcactgaagcagagacctgggaaggcgctggccccagcattcagctccagctgcaggaggtgaagacgggcaaggcaagccagttctttgggctgatggggaagcgagtgggaggaagacctctgatccagccaaggagaaaaaaagcatatcagctggaacacacgttccagggcctcctgggcaagagaagcctgttcacagaaggcagagaggatgaggcccaaggttcagagtaaaagcccccaccacagacttcccagaggacacggtgccgcttcttcctacctggatgtcacagctgacaagccggcaggccaactctcttctctgtgtctcctgtcctcatcgctggcacttcacacaaggcccacactgaacccactgggcttcttcctggactctcagtgtcaagcagcagtcctgcataaatgcacagcttcgccgtagcaagctgcactgactctgccctccctcacactcagagttggcatctcactgcacagcagtgaggagactcgcacactctgtatcctgtgcctagcacacagtaggcactcaataaatgagtg

SEQ ID NO: 1297 - DNA, 3252 bp, Homo sapiens
ttttccattaaaagcactgcaaattttagcctctaatgagattggagtcagttgacttggctttaaatattgcctcttccattttccagcttctgttactagccattgtgagcttcagtttcttcatctgcaaaatgggcataatacaatctattcttgccacatcaagggattgttattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcatcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaagaaaatagaaatacaggaatagtattcggggccattttaggtgctattctgggtgtctcattgcttactcttgtgggctacttgttgtgtggaaaaaggaaaacggattcattttcccatcggcgactttatgacgacagaaatgaaccagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaacaatgaagatgactctttactgctctgcctgaagccctagtaccataattcaagattgcattttcttaaatgaaaattgaaagggtgctttttaaagaaaatttgacttaaagctaaaaagaggacatagcccagagtttctgttattgggaaattgaggcaatagaaatgacagacctgtattctagtacgttataattttctagatcagcacacacatgatcagcccactgagttatgaagctgacaatgactgcattcaacggggccatggcaggaaagctgaccctacccaggaaagtaatagcttctttaaaagtcttcaaaggttttgggaattttaacttgtcttaatatatcttaggcttcaattatttgggtgccttaaaaactcaatgagaatcatggtaaaaaaaaaaagttaaccaaagaatatacctgtacataatttgtacagttttaagttgttagataggaactggatttcttatgtattagacattattgctcaatcataatggaatagattctgcatccctaaatgtatgaaccataaggttaaaaaagatgaatggaaatatcaaacaactttttactgagcatcagtttcataatcaataatataagaagattaatttggattctagtatgtttcagtttgtttttaattaccaccttcctttggtagaaaaaatatgttccttgatgtaggaaagtctaggttttagagattagaggatgagatcaagagttaaattcctaaagaagcactgaatatatgaagagagcaaacaaatcaagtaccaacctagaggctttatttttgaattgattcatggtgtgtgtgtgtgtgtgtgtgtgtgtgtgtgtgtgtgtgtaacacagaaacagcttcagaaaataagggatagaaagtaatgaagaaagtacttaccccatattgccataaaaatagcaaagaagactgtccctccattatcgaacaaatatgtcacctgagtagaaaacaaacagaaatattagtcatgcaaattgattataataagccagtgaatactgtttgcactcaggtactatgattttttctcaaatagaatcatattattttatagtacagaaatattatatatgaattcctttcatgggtcttgcaacaatttcacatgatttttctcatggggagaggtgaagaaacaacattagccctcttctctcctctcttgattccctttataccccaccatcatttctgattataaataattctaccattctatggaagtatttgtgggtcacagattgtcaaactacttaatgaaagttgtatgaaattagtttttcaggtgaggcattcctagttgcaattcctgttagcaaaacttctaggagtggggaagttggaaaatgcaggattcttccagtgagccagcatttcccatagctaaccctattctcttagtctttcaaaatgtagaatgggtccaataatggctataagatgtaataaatcccatcttaatttgttttaaaagtttcataaatcactgaacacttatgaaacaaagtgttttttaatcagatatcaactgaaacttcataaaggatgcatagttttataatgttattgaatcaaattttaaggcttgtattgtttgattttaataaagtataaattcaattt

SEQ ID NO: 1298 - DNA, 861 bp, Homo sapiens
atgcgcggacccgggcaccccctcctcctggggctgctgctggtgctggggccttcgccggagcagcgagtggaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagcagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttatttaaaaaaaaaacacaaaaggaatgctccacatttgacgtgtagtgctataaaacacagaatatttcattgtcttcattaggtgaaatcgcaaaaaatatttctttagaaacataagcagaatcttaaagtatattttcatataacataatttgatattctgtattactttcactgttaaattctcagagtattatttggaacggcatgaaaaattaaaatttcggtcatgttttagagacagtggagtgtaaatctgtggctaattctgttggtcgtttgtattataaatgtaaaatagtattccagctattgtgcaatatgtaaatagtgtaaataaacacaagtaataaatgaagtgtttgtt

SEQ ID NO: 1299 - DNA, 1524 bp, Homo sapiens
cgcgtgtgcgacggggtcccctccccgccgaccggcctcgtgcgctcgggcccgcacgccgttgttcgcgtcacccccacccagctcccttccgcgtgtgctcggagggcgcggcgcaccgcctacgcaggccggagcggcttccccttccctcacgtgctctccgtccgcggcctgcgcacacacccatcctggggcccgcgccccgggcctgccctggagcgccccgcgcttcagactcacccacgtgtgcggcggcggcggcgactgcgtggccccgcacccgggcggtggagagaaagggctgtcaggtggccgcggcggccggcgtgcgagggaccggatgcccaagccgggcggatttggaaaaggatagctggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataat

SEQ ID NO: 1300 - DNA, 670 bp, Homo sapiens
gggagatagtgtgagacaggagcccaggggagaaagacagaaactaagactcaaggagcaacgcaaagcaaagtcaaggagtcaagaccagagtagctgagcagaggccaagaagggtctgagagggctgtgcagcagcaatggccctaaggatgctctgggctggacaggccaaggggatcctaggaggctgggggatcatctgcttggtgatgtctctactcctccagcacccaggagtctacagcaagtgctacttccaagctcaagccccctgtcactatgaggggaaatattttaccctgggtgagtcttggctccgcaaggactgtttccattgcacctgtctgcatcctgttggcgtgggctgctgtgacacgtcccagcatcccatcgacttcccggctgggtgtgaggtacgtcaggaggcaggaacctgccagttctccttggtgcaaaaatctgaccctcggctgccctgcaaagggggagggcctgacccagaatggggctcagccaacacccctgttcctggggctcctgctccccactccagctaaactcaactgatcatccatctgctgactgctcactgctgctgccacttccagggaaaccactagcagctgccaatgtattctgaacaaataaattaatgctatagctgaaa

SEQ ID NO: 1301 - DNA, 700 bp, Homo sapiens
cattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagctgcccgccagcccaacaccttccaggctgaggggttgtcactccttcctggggctgcagagaaggaaggagccagatgctggggatacagaaggaggcttgggcacagggtcgcacaagcagaatgcagggggcccaggagctgggcgtgggggagaatcacatcttcattttcattcgcctctaactaaaaatttagcatttcctccatggcaaagagaggccgcagaccgcagcatgcggccaagcctgcaccgtggtcactggcggaagtcacagcggtttacacatcacattctagctggtgcagatatcataaatatcgttcatgctggttattgcttctcaaaacgacagaagttactagacctgctgctagatcctgatttataatcattaataaagaagcactcgcgtaacgtaaccata

SEQ ID NO: 1302 - DNA, 738 bp, Homo sapiens
ccttccacaggaagctgcacctgacagaagctccaggatgcttgttctctttctcctgggcacagtctttctgctctgcccatattggggtgaacttcatgaccctataaaagggcagagcatgtatcattattcaaaactgtcgtgtatgaccagctgtgaggacatcaacttcctggggttcacgaagagggtagagctcatctgttgtgatcatagtaactactgcaacctccctgagggagtttagttctacgtctctcctggattttgggttctttttcaaccactacgctctttttctcttccctgaacctgaattttgctctcctcttctatgcattggtagagagtgagaaagccagctcatagtgaaaagacaagcaggcataaggagacgcagtgtggacagcggagcctattgatgatggagcactagactcactctttgcacatccctgtcgctaacaggtgggaggggttttgctctccttacgtgatactgccatgaataagctcagacttggtcatttattatctcctgtatgaaaatgtgaacacttgggccataataatctccaatttgtactgagaattctgtgactatcctctatcctcatctacacacacactcctctccgttggaattctctttggattagccctgacactttctggcactgtccttttctgcccgtgggttctggagagggctaaccccagcttcccagtgtgttg

SEQ ID NO: 1303 - DNA, 761 bp, Homo sapiens; identical to SEQ ID NO: 929

SEQ ID NO: 1304 - DNA, 2550 bp, Homo sapiens
cacacacacacacacacacacacgcacacatacaatgcacaagttcagcaggattgtataatgagcatgaattgtaaatttttttccagattgtttgaacttctctggccgcacaatacaggaaggaagactaaagcagcaaagggacctacagcgtctgcagcatgggctggttaactaggattgtctgtcttttctggggagtattacttacagcaagagcaaactatcagaatgggaagaacaatgtgccaaggctgaaattatcctacaaagaaatgttggaatccaacaatgtgatcactttcaatggcttggccaacagctccagttatcataccttccttttggatgaggaacggagtaggctgtatgttggagcaaaggatcacatattttcattcgacctggttaatatcaaggattttcaaaagattgtgtggccagtatcttacaccagaagagatgaatgcaagtgggctggaaaagacatcctgaaagaatgtgctaatttcatcaaggtacttaaggcatataatcagactcacttgtacgcctgtggaacgggggcttttcatccaatttgcacctacattgaaattggacatcatcctgaggacaatatttttaagctggagaactcacattttgaaaacggccgtgggaagagtccatatgaccctaagctgctgacagcatcccttttaatagatggagaattatactctggaactgcagctgattttatggggcgagactttgctatcttccgaactcttgggcaccaccacccaatcaggacagagcagcatgattccaggtggctcaatgatccaaagttcattagtgcccacctcatctcagagagtgacaatcctgaagatgacaaagtatactttttcttccgtgaaaatgcaatagatggagaacactctggaaaagctactcacgctagaataggtcagatatgcaagaatgactttggagggcacagaagtctggtgaataaatggacaacattcctcaaagctcgtctgatttgctcagtgccaggtccaaatggcattgacactcattttgatgaactgcaggatgtattcctaatgaactttaaagatcctaaaaatccagttgtatatggagtgtttacgacttccagtaacattttcaagggatcagccgtgtgtatgtatagcatgagtgatgtgagaagggtgttccttggtccatatgcccacagggatggacccaactatcaatgggtgccttatcaaggaagagtcccctatccacggccaggaacttgtcccagcaaaacatttggtggttttgactctacaaaggaccttcctgatgatgttataacctttgcaagaagtcatccagccatgtacaatccagtgtttcctatgaacaatcgcccaatagtgatcaaaacggatgtaaattatcaatttacacaaattgtcgtagaccgagtggatgcagaagatggacagtatgatgttatgtttatcggaacagatgttgggaccgttcttaaagtagtttcaattcctaaggagacttggtatgatttagaagaggttctgctggaagaaatgacagtttttcgggaaccgactgctatttcagcaatggagctttccactaagcagcaacaactatatattggttcaacggctggggttgcccagctccctttacaccggtgtgatatttacgggaaagcgtgtgctgagtgttgcctcgcccgagacccttactgtgcttgggatggttctgcatgttctcgctattttcccactgcaaagagacgcacaagacgacaagatataagaaatggagacccactgactcactgttcagacttacaccatgataatcaccatggccacagccctgaagagagaatcatctatggtgtagagaatagtagcacatttttggaatgcagtccgaagtcgcagagagcgctggtctattggcaattccagaggcgaaatgaagagcgaaaagaagagatcagagtggatgatcatatcatcaggacagatcaaggccttctgctacgtagtctacaacagaaggattcaggcaattacctctgccatgcggtggaacatgggttcatacaaactcttcttaaggtaaccctggaagtcattgacacagagcatttggaagaacttcttcataaagatgatgatggagatggctctaagaccaaagaaatgtccaatagcatgacacctagccagaaggtctggtacagagacttcatgcagctcatcaaccaccccaatctcaacacaatggatgagttctgtgaacaagtttggaaaagggaccgaaaacaacgtcggcaaaggccaggacataccccagggaacagtaacaaatggaagcacttacaagaaaataagaaaggtagaaacaggaggacccacgaatttgagagggcacccaggagtgtctgagctgcattacctctagaaacctcaaacaagtagaaacttgcctagacaataactggaaaaacaaatgcaa

SEQ ID NO: 1305 - DNA, 1520 bp, Homo sapiens
atggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgggtgtgttgagtaaatcaattaattggagggagctggaaaagcaatattatacccagacagtttatgaagaagaaattattcacatgcttgaatactgtggaacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgttactgtttatgaaaaactaaatttttaatcatgaataatttattaaattaaataaatttattcatagaaacttttctgggttttagtaaaattgctaaatcaaaccaagattttaatatatcagcatttactttgtacccttataacatttcactcttgacttgatttgagaaacatgtttattttttgaatgttcttgtgttcaactaattttctgctgtggaaataaatacttatgatatat

SEQ ID NO: 1306 - DNA, 587 bp, Homo sapiens
agattccccagctgctgttctctggaggggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaagg

SEQ ID NO: 1307 - DNA, 457 bp, Homo sapiens
tttccaaaatggacaagtccctcttgctggaactccccatcctgctctgctgctttagggcattatctggatcactttcaatgagaaatgatgcagtgatagaaattgttcagtgtaggatgtgccacctccagttcccaggagaaaagtgctccagaggaagaggaatatgcacagcaacaacagaagaggcctgcatggttggaaggatgttcaaaagggatggtaatccctggttaaccttcatgggctgcctaaagaactgtgctgatgtgaaaggcataaggtggagtgtctatttggtgaacttcaggtgctgcaggagccatgacctgtgcaatgaagacctttagaagttaatggttcttctgtgactccaatttctgggtgaggttgttgcctcagcctcttcacaatgactttctaaaaaaaatcacacacacacacacacacacta

SEQ ID NO: 1308 - DNA, 799 bp, Homo sapiens; identical to SEQ ID NO: 1175

SEQ ID NO: 1309 - DNA, 1903 bp, Homo sapiens
gactttggttactgtcctcgtgtgtactgtgagaaccagccaatgcttcccattggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctggtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 1310 - DNA, 240 bp, Homo sapiens; identical to SEQ ID NO: 1066

SEQ ID NO: 1311 - DNA, 2463 bp, Homo sapiens
actgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgct

SEQ ID NO: 1312 - DNA, 3523 bp, Homo sapiens
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttacggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 1313 - DNA, 2039 bp, Homo sapiens
gacacagtaagtaccgatgccgcaaagggaggtccccagggcttgagggcatgtgaggcgaggagaggatggactctagagttttggggtttggggtctgcaaagctctgaaggagtctcatctctgcagtttcaggtatccaaggcagcagagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaac

SEQ ID NO: 1314 - DNA, 2881 bp, Homo sapiens; identical to SEQ ID NO: 811

SEQ ID NO: 1315 - DNA, 826 bp, Homo sapiens
gcaaacctcaggacacttactccctgagctaagggggaagagctggatcaccatgaaatatgtcttctatttgggtgtcctcgctgggacatttttctttgctgactcatctgttcagaaagaagaccctgctccctatttggtgtacctcaagtctcacttcaacccctgtgtgggcgtcctcatcaaacccagctgggtgctggccccagctcactgctatttaccaaatctgaaagtgatgctgggaaatttcaagagcagagtcagagacggtactgaacagacaattaaccccattcagatcgtccgctactggaactacagtcatagcgccccacaggatgacctcatgctcatcaagctggctaagcctgccatgctcaatcccaaagtccagccccttaccctcgccaccaccaatgtcaggccaggcactgtctgtctactctcaggtttggactggagccaagaaaacagtggccgacaccctgacttgcggcagaacctggaggcccccgtgatgtctgatcgagaatgccaaaaaacagaacaaggaaaaagccacaggaattccttatgtgtgaaatttgtgaaagtattcagccgaatttttggggaggtggccgttgctactgtcatctgcaaagacaagctccagggaatcgaggtggggcacttcatgggaggggacgtcggcatctacaccaatgtttacaaatatgtatcctggattgagaacactgctaaggacaagtgagaccctacttctccctctgcattccactggctctgccatggactatacaagcagataattttccct

SEQ ID NO: 1316 - DNA, 1725 bp, Homo sapiens
aagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttgg

SEQ ID NO: 1317 - DNA, 2881 bp, Homo sapiens; identical to SEQ ID NO: 811

SEQ ID NO: 1318 - DNA, 580 bp, Homo sapiens; identical to SEQ ID NO: 1292

SEQ ID NO: 1319 - DNA, 568 bp, Homo sapiens
acttcaccgaacgtgttgaggtacctagcacctaatcgcggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactggga

SEQ ID NO: 1320 - DNA, 7394 bp, Homo sapiens
gcgcatgcgctgagctggcgggcccgagtgttgtcggctgggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacagttcatcattcccctgcatattcttttcctgctgctatccagagaaatcagcctcagcgccctgaaagcttccttttccgagcaggtgtcagggcagaaaccaacaaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaa

SEQ ID NO: 1321 - DNA, 908 bp, Homo sapiens
cggcgaggctccggcctcgggtccggatgtataaagcgcggccccctgcggggagtggtggccccggagctgagccgccagccatggccgctccccgcgggagggccgcgccctggacgacggccctgctgctgctcctagcctcgcaggtcctgtctccgggaagctgcgcggacgaggaggaggtccccgaggagtgggtgctcctgcacgtcgtccagggccagataggcgccgggaactacagctacctgcggctgaaccacgagggcaagatagtcctcaggatgcgcagcctcaagggagatgcggatctgtacgtctccgccagcagcctgcaccccagcttcgacgactacgagctgcaatcggccacctgcggcccggacgccgtgtccatccccgcgcacttccggcgcccagtgggcatcggcgtctatggacacccctcccacctggagagcgagttcgagatgaaggtgtactacgacggcacggtcgagcagcacccgttcggcgaggccgcctaccccgccgacggcgcagatgccggccagaagcacgctggtgccccggaagacgcctcgcaagaggaggaatctgttctctggacgatattaattagcattttgaaactggtacttgaaattctcttttgagtcgttgaccacactctgggatataaaaccctccatctgtgaagctgattgcagtttgctgtgaaccttgctacttgtacttggttgaagttctaggtacctttagtcaagggatggaaaaataaagccatacgcagttttgttacctcagttaccccaaaaataggaaaagcagcaagcacagtattttaaagatcataattcctataaaaggactgtgcacaaagtgtttagactccattttcatta

SEQ ID NO: 1322 - DNA, 554 bp, Homo sapiens
gtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaatcaaacctgaagataccatgaaagcctggtggccaagagagagctataatcccagatccagctggaaagctgaagtatttcgataaactgaattgagaaatacttcttcaagttatgatgcttgaaagttctcaataaagttcacggtttcattac

SEQ ID NO: 1323 - DNA, 4509 bp, Homo sapiens
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 1324 - DNA, 3557 bp, Homo sapiens
gagaattttctccttccaaagtacagtgtaagaacagactggaagagaagttaccccgatgacttggtttggaaggggttaaggcaccagtcatcctcttctaaagtgatttatgatgatgtgtggagtttaaaaactttaccccaccccaaagaacagccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaagtggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacctattcatgagttattattgaaacctcaaatcataaagacatttaaaagaattgtttttctaactggaggggctctagtgctaaataatagtactgaaaattgatattattttccttttcttatatgaaggaccttatttggcatataaaattttataaaatatgta

SEQ ID NO: 1325 - DNA, 709 bp, Homo sapiens; identical to SEQ ID NO: 820

SEQ ID NO: 1326 - DNA, 1548 bp, Homo sapiens
gtggactctgagaagcccaggcagttgaggacaggagagagaaggctgcagacccagagggagggaggacagggagtcggaaggaggaggacagaggagggcacagagacgcagagcaagggcggcaaggaggagaccctggtgggaggaagacactctggagagagagggggctgggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattataggaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgcccc

SEQ ID NO: 1327 - DNA, 1966 bp, Homo sapiens
aggtgacaatagatatagaagtacgttgatgtgcgaagatgtattttgttttagccagcgaggaaaaaagaatcagtttgattacacatttaccaaacattaagaatttaatatggtaacttttatttcagtattaaaatagcaattttatttattacttttttatatacagaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacgcaggcacccaaaccaacggtgacctggaagacctggaggagcatgggccagggcagacagtctctgaggaagccacagaagttcacacgatggagggggacccagacacactggccgaatttctgatcagggatgtacttcaggagctgtccagttacaacggtgaggaggaggacccagaggaggtgaagacatccttgggagttccacaacgtggtgacctggaagacctggaggagcatgtgccagggcagacagtctctgaggaagccacaggggttcacatgatgcaggtggacccagccacgctggcaaagagtgacctggaagacctggaggagcatgtgccagagcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaaggcaagtgaaggatgccctgagaacatgctccaggaaacagacacccactccatagcagcccctgagcctgctgggctgagccctccacaggctgcttagtgagggagacactgaggtgctggtcgcacccccatgtgcaggactccaagggctttgcactgtgttgtctgcagtaactcttcagctcaccaacatctcatttggggggacctagctctgtcttcccagccccttgaggacaacagggagcatcactagttcatcctgaggagacactagggttgacatgaatccccctggttcaggcctcctgggaaaggtgtgagagggatggaggcacccccaggctccttgtcacacaagcgagcagcccacccgacccagtattgcaggccagcaggccctcagtaggtcctggtgtcaagcaggggacacggcaggatccaagaagcactgaaatgtgtccagtcccaggagtccttcagcctctggggggtctgggggcctccagttccaggggtccttcagcctctgtgggggcctggggtggcctcatggccccctttttcaagatgaggttggaggcttctgtatgtagagggcactggcttgggccaaatgccaacaaaacaaacccttgaagacatttcagggccatgctcacttgggagggtttgaggacatgatttagcgagcctctgttttttaaatatattttccaatcttgaaataaggta

SEQ ID NO: 1328 - DNA, 889 bp, Homo sapiens
gaggagccagagagagctgcggagagctgccagctgcagcgggcgtgttccgcagctgtaggcacctgtcgtcctgccttcgatggctcctccctccgtccccctggtcctcctcctcgtcctcttgctgagcctggcagagactccagcatccgcacctgcccaccggtcctccaccttccccaaatgggtgaccaagacggaaagagggagacagcccttgagatcctagacctgtggaaggccatcgacgggctcccctactcccaccctccacagccctccaagaggaatgtgatggagacgtttgccaaaccagagattggagatctgggcatgctcagcatgaaaattcccaaggaggaagatgtcctgaagtcatagatgtcttcaaatccctgttcctatccttcttctccagctcctcctgctccctctgaaaccttttctaggtaccctatgctgagactaagatcctgaagttaaatacccaggtctcatgaagacattgtaaagcatttgaattattctaaaaaatttctggagtttcttaggttttattgattcatccttgaaatcagtataatgtgctattaatggaaccaatagtaattcgaggactagttgggagattctggggtaatcagggaatattcctgcaacacatttaaaggaattgtgttcttttggaatcatcccaattataacacgagctattgcataatacaaataaccctcttaagtctgagagtctgtgtctttatttgaaaagattcttcaaattgcgtacttactcctccatattctttcaacccacatgagtctcctcgagaagtgaggagaggcagtttggagcagaatggagagaataaaatgtttcttgtcaaac

SEQ ID NO: 1329 - DNA, 1140 bp, Homo sapiens; identical to SEQ ID NO: 240

SEQ ID NO: 1330 - DNA, 922 bp, Homo sapiens; identical to SEQ ID NO: 819

SEQ ID NO: 1331 - DNA, 1510 bp, Homo sapiens
cactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctg

SEQ ID NO: 1332 - DNA, 803 bp, Homo sapiens
aggcccttccgcaatcggagccctcacagaggccaaactgatataaatctgcttaggaggcctgattcacagacgctacaggatggagcggggcgcaggagccaagctgctgccgctgctgctgcttctgcgggcgactggtttcacatgtgcacagacagatggccggaacggctacacggcggtcatcgaagtgaccagcgggggtccctggggcgactgggcctggcctgagatgtgtcccgatggattcttcgccagcgggttctcgctcaaggtggagcctccccaaggcattcctggcgacgacactgcactgaatgggatcaggctgcactgcgcgcgcgggaacgtcctaggcaatacgcacgtggtagagtcccagtctggaaggtggggcgcaggggtcgaggatcccttggggtgatgctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagttg

SEQ ID NO: 1333 - DNA, 1143 bp, Homo sapiens
gactttgagcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttggccccctctggaatgctgggacctgctaccaccggccctgcctggacctgtgtgggcagccctgggggcaaaggaggagatggcaggaaaggacagaacagtctactgccctctcctcatgaaggctctgggggcgagggtgggggagtgtccagggtgtcagagccctcaaaggatgcttccagagtctagtcgggtgctgctgcctaggtgtgcagagggggaacagcctggtgtgcagagagggaaaggaaggatgaggaaagccttcccggccctgcagactcctctggccctccccagcagtgcccccgcctctcctggggctggaaagcccagccatactgggtcttggctccccttgaggctccttaaaaggcaacattggaggtgggagccttggacagcttgcaaggaggcagttcagcatcttgtaataacagagttatgagcttgtaaaagcattatagaattcatagaatgcagcccttcagtcggcacctattattaaagacctactgcgtgacaggcactatgctgagctcaggagatggagcgggaatgcaacagacacagtccttgtcccatttctagtgtaaggtgaagggcatgggaagacaacaaatgagtatattctgacaagctgcccagtgttatagggaaaagagaggat

SEQ ID NO: 1334 - DNA, 600 bp, Homo sapiens
ggctcccagcaacgcctgcattttgcacattggtttgcatgactgtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgac

SEQ ID NO: 1335 - DNA, 761 bp, Homo sapiens; identical to SEQ ID NO: 929

SEQ ID NO: 1336 - DNA, 560 bp, Homo sapiens
acatgggccctgctggctgtgccttcacgctgctccttctgctggggatctcagatagagattaccattctgcccttcaggaagcagaagtacccattattgaccgccaggcttgtgaacagctctacaatcccatcggtatcttcttgccagcactggagccagtcatcaaggaagacaagatttgtgctggtgatactcaaaacatgaaggatagttgcaagggtgattctggagggcctctgtcgtgtcacattgatggtgtatggatccagacaggagtagtaagctggggattagaatgtggtaaatctcttcctggagtctacaccaatgtaatctactaccaaaaatggattaatgccactatttcaagagccaacaatctagacttctctgacttcttgttccctattgtcctactctctctggctctcctgcgtccctcctgtgcctttggacctaacactatacacagagtaggcactgtagctgaagctgttgcttgcatacagggctgggaagagaatgcatggagatttagtcccaggggcagataa

SEQ ID NO: 1337 - DNA, 2241 bp, Homo sapiens
cctgctcctgcctctaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaact

SEQ ID NO: 1338 - DNA, 1538 bp, Homo sapiens
ggttgctaaggagtgggtgcctcagaatcaggctgcaatgggcattgtctgtgcacaatgttcctttattctgctgctgtccataataagggctcgtccacctcccttcctcttctgcccattgagcagtcaaagaactgaaagtccttataagcctgtgcacctgggcctgggccctacagataaggtagctgctattgctatggcccgcatcattgacctggtgccctgggacgatggctccacacatgtgtatgcctccccggccatcctgcttcccatggagcggcagcgcaaccagctggcgggcgtgaagcagcagctctaccacccagccctgcccaccctgcgccacatggacagggacaccgtcaaggcctgccttcctgatgagcactgccagtccaccacctactgccgcaaagatgaatttgacaacgcccattttacactccttggggtccccaacaaacccctgcagtgtttggacatcaccgccacaggccagaagcttcgcaacaggtaccacgagggaaagctggcgcccatcgcgccaggcatcaaccgagtggactggccctgcttcacgcgcgccatcgaggactggtcccacttcgtgtcctcggccggggagttcaagctgccttgcctgaggaagcgagcggagggtctcagcggctacgcggtgcggtacttgaagcccgacgtgacccagacctggcggtactgcctcagccagaaccccagcctggaccgctacggacagaagcccctgcctttcgactccctgaacactttccgaagcttcggctccagctacagtcgtgtcaactacctgaccccctggcattaatctctggaaaggaggctgactcccaggctgccggacggtgccacctcaggtcccctggccagacagaggacttatggtggcaccagccatctccccaggagttcagcctaactagaaataaacctaatgctcccttagagacacacgcaattgtctctgtctgtgtgtgttgcacagcctgggagagggtcagggccacaggatgacagtatcttacccttgcccgtccccggccaactcctggaggactggtggggggttggagaaaaatgtctggtgacctggtttgagagtcagggtgtaagccgcaaggtccagccagaattgagatccaagagcaagagatgtgctccagccccttgcctgcagccccacacccaagccccctccatttcagatcctgaatttgagccctaagaagaaagggagagggctagaaagctatttttaggtgcctttttgaagctcttgtcatactggtgtgctctggggggcttccctgtgcctggggtccccctgaaggtgtgggagcaggctggggcaaggggagctggccaggcctatggccttgattcctgtgacgcaacagaatgtagagtctaaacttgcatgagatgcatgaagccactcagagaagaaagttccccgctctccaaagcaccaccaataaacatgtcatttaagc

SEQ ID NO: 1339 - DNA, 2531 bp, Homo sapiens
aagctggcgctgggggcggcggcggggtgggaaagcggcgccgccgtggggcctcctggacgcgtcggcggaggtggcttcgtcccgcggagtccaggcttcagctcctggcttctcttctttcctcctagagatcagatgtcggaactccagctgagggcatgtcttactgggcacgcaggtgtcctctcttgagaagaactgtccataccatggtggtggtaaggctttcaccagttctcaggatgcccatagggatgggtgaagcctgcctggcctgtggtgcttcccagtggccgtcatctcattagggccccacagtggcattaggatgcacctctcggcggtgttcaacgccctcctggtgtcggtgctggcagcggtcctgtggaagcatgtgcggctgcgtgagcatgcagccacactggaggaggagctggccctcagccgacaggccacagagccagccccagcactgaggatcgactacccgaaggcactgcagatcctgatggagggcggcacacacatggtgtgcacgggccgcacgcacacagaccgcatctgccgcttcaagtggctctgctactccaacgaggctgaggagttcatcttcttccatggcaacacctctgtcatgctgcccaacctgggctcccggcgcttccagccagccctgctcgacctatccaccgtggaggaccacaacactcagtacttcaacttcgtggagctgcctgctgctgccctgcgcttcatgcccaagccggtgttcgtgccagacgtggccctcatcgccaaccgcttcaaccccgacaacctcatgcacgtctttcatgacgacctgctgccactcttctacaccctgcggcagtttcccggcctggcccacgaggcacggctcttcttcatggagggctggggcgagggtgcacacttcgacctctacaagctgctcagccccaagcagcctctcctgcgggcacagctgaagaccctgggccggctgctgtgcttctcccatgcttttgtgggcctctccaagatcactacctggtaccagtatggctttgtgcagccccagggcccgaaggccaacatcctcgtctcaggcaatgagatccggcagtttgcacggttcatgacagaaaagctgaacgtgagccacacaggagtccccctaggcgaggagtacattctggtctttagccgaacccagaacagactcattctgaatgaggcagagctgctgctggcactggcccaggagttccagatgaagacagtgacagtgtccctggaggaccacacctttgctgatgtcgtgcggctggtcagcaatgcctccatgctggtcagcatgcatggggcccagctggtcaccaccctcttcctgccccgtggggcaactgtggtagagctcttcccatatgctgtcaatcccgaccactacactccctataagacgctggccatgctgcctggcatggacctccagtatgtagcctggcggaacatgatgccagagaacacagtcacacaccctgagcggccctgggatcaggggggcatcacccatctggaccgggctgagcaagcccgtatcctgcaaagccgtgaggtcccacggcatctctgttgccggaaccccgagtggctcttccgaatctaccaggacaccaaggtggacatcccgtccctcattcaaaccatacggcgcgtggtgaagggccggccaggaccacggaagcagaagtggacagtcggcctatatccaggcaaggtgcgggaggcacggtgccaggcgtcagtgcatggcgcctccgaggcccgcctcactgtctcctggcagatcccatggaaccttaaatacctgaaggtgagggaggtgaagtacgaggtgtggctgcaggagcagggggagaacacctacgtgccttacatcctggctctgcagaaccacaccttcactgagaacatcaagcccttcaccacctacctggtgtgggtccgctgcatcttcaacaagatcctcctgggaccctttgcagatgtgctggtgtgcaacacgtagcgagcaggccacagcctggcctcgggaaggtggctcctgcagttcagcgtccctgggcccattaatcccactgtggagacttctgggaactatttattgagcaggcctgtgcctccacatcatcttgttgtctctggggtgtggtgtcacagcactcctctttgccctagagataagggacctgacttccccttctcccatcctgaacatttgtacccctggagaagttccttagcagggaggaggaagaggagaggaggaagcaaagaatcacaaggaacctctggctaggtgatcctgatgtttcctactgagtttttctggtatccagatttctggaaaccgagtaatcatgtactgtttgattgggtggttcatctgcttccatcccagtgaaatttacctgtagcccagtgaagggtgtgtttggaacattcattaaatgattctaagcatc

SEQ ID NO: 1340 - DNA, 1300 bp, Homo sapiens
gcagacccagcgccgagcccgagccatggcgtccgagcggctccctaacaggcccgcctgtctgctcgtggccagcggcgccgccgaaggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgccgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccactgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtggtcactgttgactagacagagtcggctcgggggtcctctgtgtgggtttgccctgctgtggcctgtctgccacccaccacctctttcactgttggtgggggccttgaggggagggcccagccggcgggagctggctcagaactttggccaaaggtgaacggaattttttaggagcagcagcctcctgccccaaggccgaccggcactggcagcactttcctgttgaagaaatcttcctggcgtgtggtttcaaagtgtaagcacctcagtgatgcaccctgtcctaagcattgagaggcacgtttacttgtgaatatgagaccatgagattctcaatgataggaaagtgctgtcccccacgg

SEQ ID NO: 1341 - DNA, 2995 bp, Homo sapiens
cggctcccccgccgtccgcgtctgcgccggccccggggcctggtcggcggcggcggggccggtcgatggcccgggcggcggcggcggcatgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagatttgctgtcgctttcacagagtcaatgaaggaaatggcacaagcgcagtggccgcatgctaagggtaaggtctatgtccagagtcaaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaagtcgatccagtgtttacaagggaagtgaaagccaaagtgaaaagagccgctggggtacgattgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggcccaagggttatggctttcatgtctaggtgtggggacagaggagggagaggcagatcctgggccgggagaggatggcctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccatta

SEQ ID NO: 1342 - DNA, 1479 bp, Homo sapiens; identical to SEQ ID NO: 1142

SEQ ID NO: 1343 - DNA, 372 bp, Homo sapiens
tctggaacattagacaggatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagcctggggcatcgccaagagcctga

SEQ ID NO: 1344 - DNA, 1971 bp, Homo sapiens
aggaaaggtggttggcttacggcacagtagagagcttccagggctggctggcgtgggatacccgtaccacagaaatgcagggaccattgcttcttccaggcctctgctttctgctgagcctctttggagctgtgactcagaaaaccaaaacttcctgtgctaagtgccccccaaatgcttcctgtgtcaataacactcactgcacctgcaaccatggatatacttctggatctgggcagaaactattcacattccccttggagacatgtaacgctattgaaactcaagcgattacagacaattgctctgaagaaagaaagacattcaacttgaacgtccaaatgaactcaatggacatccgttgcagtgacatcatccagggagacacacaaggtcccagtgccattgcctttatctcatattcttctcttggaaacatcataaatgcaactttttttgaagagatggataagaaagatcaagtgtatctgaactctcaggttgtgagtgctgctattggacccaaaaggaacgtgtctctctccaagtctgtgacgctgactttccagcacgtgaagatgacccccagtaccaaaaaggtcttctgtgtctactggaagagcacagggcagggcagccagtggtccagggatggctgcttcctgatacacgtgaacaagagtcacaccatgtgtaattgcagtcacctgtccagcttcgctgtcctgatggccctgaccagccaggaggaggatcccgtgctgactgtcatcacctacgtggggctgagcgtctctctgctgtgcctcctcctggcggccctcacttttctcctgtgtaaagccatccggaacaccagcacctcactgcatctgcagctctcgctctgcctcttcctggcccacctcctcttcctcgtggggattgatcgaactgaacccaaggtgctgtgctccatcatcgccggtgctttgcactatctctacctggccgccttcacctggatgctgctggagggtgtgcacctcttcctcactgcacggaacctgacagtggtcaactactcaagcatcaatagactcatgaagtggatcatgttcccagtcggctatggcgttcccgctgtgactgtggccatttctgcagcctcctggcctcacctttatggaactgctgatcgatgctggctccacctggaccagggattcatgtggagtttccttggcccagtctgtgccattttctctgcgaatttagtattgtttatcttggtcttttggattttgaaaagaaaactttcctccctcaatagtgaagtgtcaaccatccagaacacaaggatgctggctttcaaagcaacagctcagctcttcatcctgggctgcacatggtgtctgggcttgctacaggtgggtccagctgcccaggtcatggcctacctcttcaccatcatcaacagcctccaaggcttcttcatcttcttggtctactgcctcctcagccagcaggtccagaaacaatatcaaaagtggtttagagagatcgtaaaatcaaaatctgagtctgagacatacacactttccagcaagatgggtcctgactcaaaacccagtgagggggatgtttttccaggacaagtgaagagaaaatattaaaactagaatattcaactccatatggaaaatcatatccatggatctctttggcattatgaagaatgaagctaaggaaaagggaattcattaaacatatcatccttggagaggaagtaatcaacctttacttcccaagctgtttgttctccacaataggctctcaacaaatgtgtggtaaattgcatttctcttcactatggtgtattcagtcaatgcttgtccctggaaacccaaagcatgaccactgcaaatatttccttgactttttgtaaatgaagaggtccttttcctcaagttcttagtcccactcatccta

SEQ ID NO: 1345 - DNA, 5992 bp, Homo sapiens
gccccagcttggccgggcgcggagcggggcgcatggcgccgggcgcactgcgcgggggctgcgaacaaagggcccccggcggcggcgcgaggacggccgcgctcggaccctggccctggcccagccctggcccggccccctccccaggcgcggcgccccccaggagccgaaaaatgagcggcgccctgctctggccgttgctcccgctcctgctcctgctgctgtcggcgcgggacggcgtgcgcgccgcgcagcctcaggccccgggttacttgattgcagctccctctgtttttcgcgcgggcgtggaggaagtcatcagcgtgaccatctttaactctccaagggaagtcacggtccaggctcagctggtggcccagggtgagccggtggtgcagagccagggagccatcctggataaagggacaatcaaactcaaggtgcccacgggcctccggggccaagcgcttctgaaagtgtggggccgcggctggcaggcggaggaggggcccctctttcacaaccagacctcggtgaccgtggacggccggggcgcttctgtattcatccagacggacaagcctgtgtacagaccccagcaccgagtgctcataagcatcttcaccgtctctccaaatctgaggcctgtcaacgagaagctggaagcctacatcctggacccccgaggctctcggatgatagagtggagacacttaaagccgttctgctgcggcatcaccaacatgagcttccccttgtccgaccagcctgtgttgggagaatggttcatttttgttgaaatgcaaggccacgcgtacaacaagtcttttgaagttcagaagtatgtgttgcccaagtttgagcttctgattgacccgccccggtatatccaagacctggacgcctgtgagacaggcactgtgcgggccaggtatacctttgggaaacctgtggctggtgccttaatgatcaacatgactgttaatggtgtagggtactacagccacgaggtgggacgccctgtcctcagaacaaccaagatcctcggctcccgggacttcgacatctgcgtgagggacatgatcccagcggacgtccctgagcacttccggggcagggtcagcatctgggccatggtgaccagtgtggacgggagccagcaggtcgcgttcgatgactccacccccgtgcagaggcagctggtggacatccggtactccaaggacacgaggaagcagttcaagccgggcctggcctacgtggggaaggtggagctatcctaccccgatggcagcccagctgagggggtgacggtccagattaaggcagagctgacaccaaaggataacatctacaccagtgaagttgtgtcccagcgtggactagtggggtttgaaatcccctccatccccacgtcagcccagcacgtgtggctggagaccaaggtgatggcactgaacgggaagcctgtgggggctcagtacctgcccagctacctctccctcggcagctggtactcccccagccagtgctacctgcagctgcagccaccctcccacccactgcaggttggggaagaagcctatttttctgtgaagtccacatgtccctgcaactttaccctgtactacgaggtggctgcacggggcaatattgtgctatcgggccagcagcctgcccacaccacccagcagcgaagcaagcgggcggcccctgccctggagaaaccgattcgtttaacacacctttctgagacagagcccccaccagccccagaagctgaggtcgacgtgtgtgtgacctctcttcatctggccgtgacccccagcatggtcccccttggtcgcctgctggtcttctacgtcagggagaatggagaaggggtcgccgacagccttcagtttgcagtcgagaccttcttcgaaaaccaggtttcagtgacgtattcagcaaatgagacccaacctggggaggttgtcgacctgcggatcagggctgcaaggggcagctgtgtgtgcgtcgccgcagttgataagagtgtctacctgctcaggtctgggttccggctgactcctgcccaggttttccaggaactggaagattatgatgtttctgattcctttggcgtgtccagggaggatggtcctttttggtgggctgggctgacggcacaacgacgccggcgctcctctgtcttcccgtggccttggggcatcaccaaggactctgggtttgccttcaccgaaacgggactggtggtgatgaccgaccgagtgagcctgaaccaccggcaggacggtggcctctacaccgatgaggctgtccccgctttccagccccacacagggagcctggtggcagtggctccttccaggcacccccccagaacagagaagagaaaaaggactttcttccccgaaacatggatttggcattgtctcaacatcagtgacccatctggtgaggggacactcagtgtgaaggtcccggactccatcaccagctgggtgggtgaggccgtggccctgtccacctctcagggcttaggcatcgccgagccctccctgctgaagaccttcaagcccttcttcgtggacttcatgctccccgctctcatcatccgtggggagcaggtcaagatcccgctcagtgtctacaactacatgggcacctgcgctgaggtgtacatgaagctctcggttcccaagggcatccagtttgttgggcatcctggcaaacgccatgtgaccaagaagatgtgtgtggcccccggggaggctgagcccatctgggtcgttctgtccttcagcgacctgggactcaacaacatcacggccaaagcccttgcttacggagacacaaattgctgccgggatgggaggtccagcaaacaccctgaggagaatcacgccgacaggagggtccccatcggggtggatcacgtcaggcgcagtgtgatggttgaggcggaaggagtcccccgggcgtacacctacagcgcattcttctgtcccagtgagagagtccacatctccacccccaacaagtatgagttccagtatgtgcagcggccactgcgcctcacccgctttgatgtggctgtgcgagctcacaatgatgcccgtgtggccttgtcttctgggccccaggacacagcaggcatgatcgagatcgtcctgggggggcatcagaacaccaggtcatggatctccaccagcaagatgggagagcccgtggccagtgcacacacggccaagatcctctcctgggatgaattcagaacattctggatcagctggcgtggtggccttatccaggttggccatggtccagagccatccaatgagtctgtcattgtggcctggaccctcccgaggccaccagaggtccagttcattggcttttccaccggctggggctccatgggtgaattccgaatctggaggaagatggaggtggacgagagctacagcgaggccttcaccctgggggtcccacacggcgccatccctgggtctgagcgagccaccgcctccatcatcggggacgtcatggggccaaccctgaaccacctcaacaacctcctgcggctgccgtttggctgtggagagcagaacatgatccactttgcacccaacgtctttgtcttgaagtatcttcagaaaacccagcagctcagccctgaggtggagagagagaccaccgactacctagtacaaggctaccagcgccagctgacctacaagcgccaggatggctcctacagcgcgtttggggagcgggacgcatcggggagcatgtggctcacagcctttgtcctgaagtccttcgcacaggctcgcagctttatcttcgtggacccccgggagctggctgccgccaagagctggatcatccagcagcagcaggccgatggctccttcctggccgtgggcagggtcctgaacaaggacatccagggtgggatccacggcactgtcccgctgacagcctacgtggtggttgctctcctggaaacaggcacagcctcagaggaggagagaggctccactgacaaagcgaggcacttcctggagtctgctgcgcccctggccatggacccttatagctgtgccctgactacctacgcgctgaccctgctccgcagcccggcagcccctgaggcactgcgcaagctccgtagcctggccatcatgcgagatggggtcacccactggagcctgtcaaattcctgggacgtggacaagggcacattcttgagcttcagtgacagggtctctcagtcagtggtctcggccgaggtggaaatgacagcctacgcccttctgacctacactctgctgggtgacgtggctgccgccctgcctgtggtgaagtggctgtcccagcagcgaaatgcacttgggggcttctcctccactcaggacacctgcgtggctctgcaggccttggctgaatatgccatcttgtcctatgctggaggcatcaacctcactgtctccctggcctccaccaacctggactaccaggaaaccttcgagctgcacaggaccaaccagaaggttctgcagacagcagcgatccccagcctccccacggggctgtttgtgagtgccaagggggacggctgctgcctgatgcagattgatgtcacctacaatgtgcctgacccggtggccaagccagctttccagctgctcgtaagcctccaggagcctgaggcccagggacgcccgccccccatgcctgcctccgcagctgagggttcccgaggagactggcccccagctgacgatgatgacccagcggccgatcagcatcaccaggaatacaaggtgatgctggaggtgtgcaccaggtggctgcatgcagggtcttccaatatggctgtcctggaggtgcccctgctgtcaggcttccgggcagacatcgagagcctggagcagctgctccttgacaagcacatggggatgaagaggtatgaagtggctggacgccgagtgctcttctactttgatgagatccccagccggtgcctgacgtgcgtgcggttccgtgctctccgggagtgcgtggtgggcaggacgtcggcgctgccagtctccgtgtacgactactacgaacccgccttcgaggccactcgcttctacaacgtcagcacccacagcccactcgcccgggaactgtgcgccggacccgcgtgcaacgaagtggagcgcgcccctgcccggggcccgggctggttccccggcgagtcgggccctgccgtggcccctgaggagggggcggcgatcgcgcgatgcggctgcgaccacgactgcggcgcccaggggaacccggtgtgcggctccgacggggtggtctacgccagcgcctgccgcctgcgggaggccgcctgccgccaggccgcgcccctggagcccgcgcctcccagctgctgcgccctcgagcagcggctgccggcctcgtcgtcctccacctacggggatgacctggcttctgtggccccggggcctttacagcaggacgtgaagctgaatggagccggccttgaggtggaggactcagaccctgagcctgaaggggaggcggaggacagggtcacagccgggcctcggcctcctgtgagcagcgggaacctggaaagcagcacccagagcgccagcccgttccacagatggggccagactccggcccctcagagacatagtggccgggtggtgggggcccacaggccagggcttctgagccctgtcttcgtctacagcccagcctttcagagtggtggggaggagggtttatggatgtcaaacacctgcaccttgagataatcctacaaccacatgcagttgtgggaccgcagtttggtcctggggaccattcatacccacacacccagcttgtgcctgtggttaacatctcagaaaactctggtaaatgatcactccaggatattgacaagaatacacgttactgatcttactcacatgtt

SEQ ID NO: 1346 - DNA, 603 bp, Homo sapiens
gtacctgtagctgcggcgctgaggtcggaacgtctgcgtgtgtgcgggctggttttgtggcggctgctgctagagctggagcatttgccgggttggtggctcctgcacatttttacagttctccagtccttctctttcgaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttccca

SEQ ID NO: 1347 - DNA, 4628 bp, Homo sapiens
cttaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctg

SEQ ID NO: 1348 - DNA, 4299 bp, Homo sapiens; identical to SEQ ID NO: 841

SEQ ID NO: 1349 - DNA, 850 bp, Homo sapiens
actcatacagtgacctagagcaggcatgggtgggtcacaggctttggagagcactctctgtcctgatcttttcagttgagagacttcagctgttcattgctcatttggacttagttcaaggtcatgtcaaagaagaaggtgcacttacgctagttgttagctctgtcttttgtaaccatcaagttccatgcgattgatcagatttaggagggggcgttgggggataatcaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaa

SEQ ID NO: 1350 - DNA, 3511 bp, Homo sapiens
acttcctctctttgttgtcctcgtattttcttttcctcctgagatttaacttgaagacaacgtcactagcagtttctggagctacttgccaaggctgagtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccggcaaggaccccgtaggacgtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacggaccaatggcagtctggtgttggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaaggcggccgcggccgaggcccgccacgaggtgcgccagctgcacagcgccttcgccgccctgctggaggacgcgctgcggcacgaggcggtgctggccgcgctcttcggggaggaggtgctggaggagatgtctgagcagacgccgggaccgctgcccctgagctacgagcagatccgcgtggccctgcaggacgccgctagcgggctgcaggagcaggcgctcggctgggacgagctggccgcccgagtgacggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggccgaggccggggccggggccgcctccctcaacgcctcccttcacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacggcctgggctccaactcttcaccacaccctgtattctacaacttctttggtgttttgctcctcctgtggttggaaacttctgtacaacactttaaacttttctcttgcttcctcttctcttctcccttatcgtatgatagaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggcagctgagggaggagggaaagaagactgtaaaaatccccctcactaatgatcaactttggaataaagtgatgcccttc

SEQ ID NO: 1351 - DNA, 1050 bp, Homo sapiens
gacatgggctccgctccctgggccccggtcctgctgctggcgctcgggctgcgcggcctccaggcggggggtgagtggcggcgccccccggcccattccccggtcccggccccgcctctgaggttcgcgtccccccacagcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggcagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggtgtg

SEQ ID NO: 1352 - DNA, 709 bp, Homo sapiens; identical to SEQ ID NO: 820

SEQ ID NO: 1353 - DNA, 1534 bp, Homo sapiens
tgggcttgagggtcgatttttcaccttttgaaggacaagatgcattggaagatgttgctgcttctgctgttgtattacaatgctgaggcttctatgtgccacaggtggagcagggctgtgctcttccctgccgcccaccggccaaagaggtcctcatcactgccattgaacccagtcctgcagacctccctggaggaggtggagctgctctacgagttcctgctggccgaacttgagatcagccctgacctgcagatctccatcaaggacgaggagctggcctccttgcggaaggcctcagacttccgcaccgtctgcaacaacgtcatccccaagagcatcccagacatccgccggctcagcgccagcctctccagccaccctggcatcctcaagaaagaagactttgaaaggacagtgctgaccctggcctacacagcctaccgcacagccctgtcccacggccatcagaaggacatctgggcgcagtccctcgttagcctcttccaggccctgaggcacgacttgatgcgctcctcacagccgggagtacctccctgagagactggcccacaccaggacctcagagcagggaccagcacagtaatccagaaagtcttcattctctactccatttacagagaccagcaacaaaactcttaccgctgacacagagcagcagagatcaaacagtaaccccgatgctcttttctccttgtagtttcctggaagacacatctgattcatgccatcatgtgacctgggctggaagaaagggctggaatggtcattcaagacgcctccatgggcagaatggtttgcctatggcaggcagaattctgatatgcttcaacccagagcgtgagccaccgtgcctggcccaggatctaaaaactttctaagtttcctccatcgttggcatcctcacagctatctccaatgtcactcaagagacatcaacagacatttaactgctgcagacttcattgctctgtcacctcaccttgaatctaacaaatcaaagtatttctgcaggtccaatggtctaaaatcaaatgcttgttaaatgactttttacaacaccccttactttcctaatccatttcaatcttattttttttattgtggtaaaaaacacatcaggtaaaatgtaccatcttaaccatttttaagcatatggtacagcagtgttaactccatgcatgttgtgaaacagacccccggaactttctcatcttgtaattctgaagttctatacccaccgaacaactcctcttttccccttccccctgcctgccccagctcttggcaccattattctgctttctgtttttgagagtctgactacttaagatacctcatacaagcgggatctggcttacatttcttgagcattgtattctggaaaagtgtttccttcctctgaaaaatgggtagagttctgaaggagaactactggtcttattgtacacttgctgtacctatttttatttaacaaatattcatctatggtataataaagatgtcatgattg

SEQ ID NO: 1354 - DNA, 1479 bp, Homo sapiens
tctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactctgctccctgtgtccccaatggctctgcgttgctgctctccaatccagcctaccgcctccttctggccacttacgcccgtccccctcgaggcccgggcccccccacacccgcctgggccaaacccaccaacacccaggggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaac

SEQ ID NO: 1355 - DNA, 943 bp, Homo sapiens
gagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctgggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtg

SEQ ID NO: 1356 - DNA, 873 bp, Homo sapiens
tcgctggcaccggccgcacgcgtccatcccgggcctctgagcggagggggagccgaggctagagggagggcgcagtctgcccaaggtcagcggcagcggcagtttctgggcgccaagtgtgattggagtactccaggaagaggggcgtgaccagagctctagcgaagagacctgacattgtaaagctagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacagg

SEQ ID NO: 1357 - DNA, 534 bp, Homo sapiens
gagtttaccatctgaaaggaggcaaatcctgactttcgtttcttctctctactagctggcaatatagcaactatgaagagaaaagctactaataaaattaacccaacgcatagaagacttttttttctcttctaaaaacaactaagtaaagacttaaatttaaacacatcattttacaacctcatttcaaaatgaagacttttacctggaccctaggtgtgctattcttcctactagtggacactggacattgcagaggtggacaattcaaaattaaaaaaataaaccagagaagataccctcgtgccacagatggtaaagaggaagcaaagaaatgtgcatacacattcctggtacctgaacaaagaataacagggccaatctgtgtcaacaccaaggggcaagatgcaagtaccattaaagacatgatcaccaggatggaccttgaaaacctgaaggatgtgctctccaggcagaagcgggagatagatgttctgcaactggtggtggatgtagatggaaacattgtgaatg

SEQ ID NO: 1358 - DNA, 1533 bp, Homo sapiens
gaggccacaacacacagagatggagaagctctaaacttaccactgaaggaaagcaggcacttaaagtttatcccaaacaaaactgtaattttaactggtccccgagttgagcctcactcgatgaatgacttccagggcctttggctctttgggactaaacgagaaaattatttttagcacaactatttggaaatctttgagaatttggatctgttattctgtctggtaccaaagcaagtttttcactgagctctcatgaaagatcctcagtctcttgtggatttagaatcctgcagcagcccaccatctaagagcaagagccaaagatgtttgtcttgctctatgttacaagttttgccatttgtgccagtggacaaccccggggtaatcagttgaaaggagagaactactcccccaggtatatctgcagcattcctggcttgcctggacctccagggccccctggagcaaatggttcccctgggccccatggtcgcatcggccttccaggaagagatggtagagacggcaggaaaggagagaaaggtgaaaagggaactgcaggtttgagaggtaagactggaccgctaggtcttgccggtgagaaaggggaccaaggagagactgggaagaaaggacccataggaccagagggagagaaaggagaagtaggtccaattggtcctcctggaccaaagggagacagaggagaacaaggggacccggggctgcctggagtttgcagatgtggaagcatcgtgctcaaatccgccttttctgttggcatcacaaccagctacccagaagaaagactacctattatatttaacaaggtcctcttcaacgagggagagcactacaaccctgccacagggaagttcatctgtgctttcccagggatctattacttttcttatgatatcacattggctaataagcatctggcaatcggactggtacacaatgggcaataccggataaagaccttcgacgccaacacaggaaaccatgatgtggcttcggggtccacagtcatctatctgcagccagaagatgaagtctggctggagattttcttcacagaccagaatggcctcttctcagacccaggttgggcagacagcttattctccgggtttctcttatacgttgacacagattacctagattccatatcagaagatgatgaattgtgatcaggaccaagatccctgtggtaaacactctgattgaatctggggttccagaaggtggaacaagcaggaatgggatccaaagagactcccactcagattctaaagcatttaaagacaattctagcagaatttatcaaaacaagatgaaacacagaaaagttgaaaccacaacaaaatgaattctattaaagaatagccccagatataaattctcttgaaagcaatgttcataaatatttaagcaaattaaagacaatgttaacaaattttctattaaatgccctgagtgataaaaccagttggcaataatattgccttattaaatcttcaaaaaata

SEQ ID NO: 1359 - DNA, 1812 bp, Homo sapiens
ctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 1360 - DNA, 954 bp, Homo sapiens
tcaacacaacttgcttctctccagacttgggcttaaggctctgataaccatgaggcttctcattctcacctgtcttgtggctgttgctcttgccaggcctaaacttcctcttagatacccagaacgccttcagaatccatcagagagcagtgagcctataccattagaatcaagagaggaatacatgaatggtatgaacaggagaaacattctgagagaaaaacagactgatgaaatcaaggatactaggaatgagtctactcagaactgtgttgtggcagagcctgagaagatggaatccagcatcagttcatcgagtgaggaacagttttgtagactgaacgaatacaaccaacttcagctgcaagctgcccatgcccaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagttttctagtggacattttgtttaaaaagtctttgaattgccagttctgtaagtgccatcaattaaaatagttttgtgcagtgacagagattttcttttttcttttcaataaattacactttaaggc

SEQ ID NO: 1361 - DNA, 590 bp, Homo sapiens
ccctggggaagagaagctgagaggaactcctcactcagctagcttcaggagccatgacatcatctctaccatggaaattccactcactctcctgtgcccccacatttgtcctaggcctcagagtccctataaagagagattcccaactcagtatcagcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccata

SEQ ID NO: 1362 - DNA, 2038 bp, Homo sapiens
agccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaagtggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaagccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacct

SEQ ID NO: 1363 - DNA, 2129 bp, Homo sapiens
gagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataagattgaagagcaatcagattgtaagatcttagatggacactttgtttcccccatggctcactatgtgcctgatatcatgccaattgaatctgttattgcaaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcaggtaagacggctggtctaaacatgtattcgttcatttgttgtttgttttctggattttttgcttcaacaaatgtaaaagatcacatatttttatagtctgtttcaatctttgaattccctcctcacctcccacaaatctcacagagttacttttccctctttcctagaatttgatcttcttattttcttctagagaactaagcatgatgcatattataggcatgctttatcgtgtggctttcccctcttcaaatattaatggccaggtattttaggatgtgagaaggaagatcatggcttgttaaagttgctttggtgcatcaagagttttttcactctattctgatgttttttcagaatggcctgaacatctgtggaataatttagcaatgtttttcagttagcaagtgaatattgaaccttaaataagaagtgcttttaatgtgaacaaccttatatgactccactattttagttagaacttataaaaacttttatgctggctgggcgcggtggcttacgcctgtaatcccagcactttgggaggcggaggcgggtgtatcacgaggtcaggagatcaaggccatcctggctaacacggtgaaaccccgtctctagtaaaaatacaaaaaaaaaaaaaaa

SEQ ID NO: 1364 - DNA, 4494 bp, Homo sapiens
tggagcgaaacctcaactatgccaggcgtcggcccgtaggaaggcagggaacacagagggcgctgccctcggcggcagcggcagattgttccccattttggagatgaagaaactgagactcaaagcagctgagtgaccttcccaaggacacacactgaactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgccagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcaaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatatactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtaagtgtgtgtacactgttcaatatggttcaatatggtaccaatagccacatgtgactatttaaattcattgcaatgaaataaaattaaaggtatactagctc

SEQ ID NO: 1365 - DNA, 2154 bp, Homo sapiens
gagctccgcccctcgcccggctcagctctcccggtatctggggctttgagcgtcccgggttgggcagggaactggcagcatagctcctaggatgcgagggccatttgtctccggccgggggtcagatcctcgggaagccgagccatcccatccagccgcttgccccaaaccgggcgcaggccgtggtcacttctctaggaagctccgaagatcccgccactccgtccctcaaaggtgcggaaagccggcttcccccagccctcggagaagattcctgactctccgctcggtcggggcatctgagggcaggagctgcgccaggcgtaccggatagaccagtggacaacacccacgccggaccgcctgtcccctacccggacccagactcggcgccgcacattgccccgggggggcccggcgcagtcacgcgcgcgcagagctcacgctctccgccccgcacacctgcgctccgccccctggtcctgggcccgcgacgggtgaaggcatttgggaagccagggcggctgcggaggcgatctccctgacccagggccggagttgcccggagcctgccaccgctctcagccagcccgcatccttctctgttcttccctccccccgcctgccacggcgcgggtatccgcagccacagcccggggccggtgaggcggcgaagggggaggggaggaatcaagggatgagcgccggaagggcgtcgggggccctgagccgcactaggacgcccctggagccggaaccccagcagaagccggaaccagaaccaaatcaccgctgcagccccctaaacccaggaggcgccctggcccgcgctcgccccccagggcctcatgtcggaaccacagcctgacctggaaccgccccaacatgggctatatatgctcttcctgcttgtgctggtcttcttcctcatgggcctggtaggcttcatgatctgccacgtgctcaagaagaagggctaccgctgccgcacgtcgaggggctctgagcctgacgatgcccagcttcagccccctgaggacgatgacatgaatgaggacacagtagagaggattgttcgctgcatcatccagaatgaagccaatgctgaggccttgaaggagatgctgggggacagtgaaggagaagggacagtgcagctgtccagtgtggatgccacctccagcctgcaggacggagccccctcccatcatcacacagtgcacctgggctctgcagccccttgcctccattgcagccgcagcaagaggcctccacttgtccgtcagggacgctccaaggaaggaaaaagccgcccccggacaggggagaccactgtgttctctgtgggcaggttccgggtgacacacattgagaagcgctatggactgcacgaacaccgtgatggctcccccacagacaggagctggggctctggtgggggacaggacccagggggtggtcaggggtctgggggagggcagcccaaggcagggatgcctgccatggagaggctgccccctgagaggccacagccccaggtcctagccagccccccagtacagaatggaggactcagggacagcagcctaacccctcgtgcacttgaagggaaccccagagcttctgcagagccaacactgagggccggagggaggggcccaagcccagggctgcccactcaagaggcaaatgggcagccaagcaaaccagacacttctgatcaccaggtgtctctaccacagggagcagggagtatgtgagtctccttcattgtgctgatggactaccagctggcagggccagggggtgggtgggcgtgaaagccctcccctccactggacagcactgccccccagctgagggaccagctctacttccacctggagttgcacagtctcaggctgggggcctcaggagaggtcacagcccctcagtctcttctccttcccctgcctgcaacaggctgcctgccccgccttccccaacacctcgctccatatgatagagcgtggcagctgggagcaggcccctgcccgtggtgggcccctaaagcaatagcaccgtaggccccctgccctcttagcacaagaggcccaggccctggcctggccttcgtgccctttattcattgtcaataaatccgctcagaccatt

SEQ ID NO: 1366 - DNA, 560 bp, Homo sapiens
cgttggaacgtccttgggcttctgaactagtgcccatgtgtgcctcggcctttcccaagggccagcttcttcctgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctga

SEQ ID NO: 1367 - DNA, 2169 bp, Homo sapiens
cctctggctgaaagtagccggaaaggcctggctacttatgggctaagggttttgaatctgggctgcagattgtgcagagagttaatttacaaccttagaacagtggacaatgcttgatagtgtcagactgtgggcactggaaaccggctggtctcaggatagggatcctatacctccaacacttggattgctgacctttcacttctcaacttggtcaacggaagtcaaaaaccccagcaaggccacctgctgaattctagaacttccaggacttcccgacctagagcacatggccaaacactttctgcagccaggatgtcactgccctcccctgattaagataaatagacttggcctaataattatccaaatagattaattcttccaacaaaagaaagagttctggaagtcaatacccaatagccttctttcctgatggtgcagtagagagcaaaatccatctctaagcccagagttcgtgatattttggaaatagctacaatggtgaatttcaccccctggagagttctgtcactggcacttgttccagggttccagcagagtccctcttctcaaataggaagcactggctcagaagactgtccccagcataagatggagtctcgctctgtcacccaggctggaccatgagtgcttttttaaacctcattttaaatctgaaagaagaatgaatacattggacaggctgtcgaaacctcagtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcaacaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgctccagta

SEQ ID NO: 1368 - DNA, 1336 bp, Homo sapiens
ccctagcttctttttcctgcacaagggatttccgggtcaggatgaacaaacacttcttgttcctcttcctcctttactgcctcattgtggcagtgacatcacttcagtgcataacatgccaccttcgcacacggacagaccgctgtagaagaggctttggtgtctgtactgctcagaagggcgaggcatgcatgctcttaaggatttaccagcgcaatactctccagatatcatacatggtgtgtcagaaattctgcagagacatgacatttgatctcaggaatcggacttatgttcatacatgctgcaactacaattactgtaactttaaactctaagatatttgccctcctgaggtctcgctttggaatgtccccaatgttgctcatccttcacactctgctggcccttgcttcccttccgtgtctgtcctgacaatacccctgccctcgcattaacctaagaagactaaactagtgtgatcctttctggtgtcttcagcttggcttctccctcagtcagagaatagtggttctgaacaatggatttcttctattattgggattattggcatggccatattccaagaaacctgccccaagagttcctgtacagtaaaatttaaagcaggaacattctagaatcttaatttgcttaactagttcaggtacactagaaagccttcagctaaaaattcacaatatttttatctaaaattcccatgtatccggagaatgactaagcagaaatagcaattaaatggatgatggatactgaagatttttctctacggacaccaagttatttctaccagcaggcagtgcccacttcaaactcaaccattgtgattttcttggcatttacaaactacatccttacactgttattaggagatagcaaacaaggatcttcccggcctctgtgacattcaccgagctctcacacagccactgctactcctatcgagatgtacattcaaggtacatcagaactctcatttcttccccttcctttcctaaaccttctctcttcctttccccctttgccattcacctttactatcacctcccacctccattatcacctccccattgccacacaacctctccctgtagagaggcaggaggtccttcgaagctttgccccatgcgtcagatggcacctgaggcatataacctagggtgggctgcctttcaggatccgtcatcaaagggagtcaaacatagtcaagataccatctaccctgtacagctttcttgagacttgggggcctgggtcaaagagatttgtctgtcccttgctgcccatctttaagtaataaaccgacttcacataa

SEQ ID NO: 1369 - DNA, 2064 bp, Homo sapiens
gacactgggaacctggggcagaatcagacccagcgtctgactcctcctgagagggctcccttttttctcctctcctccgctgtcagaaacagatctgggctggaatggcctggggtggggtccacacctgctgcttccacctgtgctgctgctgctcctggcctcagggtgctgtgcctgaagaacttcacaaacacccaggacagaccctcctcctgcaatgccagtactcacccaagagagggccctatcagcccaaatcctggtgtcagcagacatctccaagtcggtgtaccttacttgtcaccagctccaagccctggacagcagttcagaagtctcattacacaatctgggacaagcccaatgctggcttcttcaacatcaccatgattcagctgacacagaatgactcgggattctactggtgtggaatctacaacgcttccgaaaacatcatcactgttcttagaaatatcagcctggtggtgtctccagccccaaccacgtctcctatgtggactcttccctggctcccaacaagcacagcttgggagcctcagattcaggaaatcaagttcagggctcccacagattctacattatggaaatcaagagcccctgcctgccttggctcaggtggccccagattcctggtcttggtgctatgtggactcctcctggccaagggcctgatgttgtgagtcctgttagtgctcctgatctgcaggtgccacaggacagcagtgacgaggtttctgattgtcccagcacagccttgtcccaggacccttgggtgcatgagccacaacatggatcctggatgaatcccagttcttcccctgcccagctattgggagctggcctaagtattgctccccacctccttgtgaggaaaggctagcgctaagcctattggagagaactttcagcccctgaactccccggtggtgacccctcacccctgcactgagcccccttagatctactgcccctgccctgactttcgccattgggaagacctggggtgggggtttctgcatccgggtcaatgcccagctcagcatcttcagctgtgcccaggctcctctccagcactctgtcgttctctgagccccacctcagcaggtctccaggatccctcacatttcccctgtttgttgcctgtggtctgccctagagtcctatgaatttcctcttgtgcttaattaaattcaacctctgaactgaaatgtgtcaggggcagctgagcaagacagcagttgtatcccctcaccttcctcccgtcccaccccagatatcctaaatgagagagaaatgacttaaaaataaatgataaaattgaaactaagaaaggctgtaatcagcagactggaagctgaggaagatctagaagtaaaagaaaaaattagatgcgttaaaatgacatgagcaggcgactcagtggcccaaaacaggacccagaacattcatccgtaaatggaatctgataatctggggcccaaattctgtttacttaacatgtgagaagattcacagcctaaaagagaaaatcaagttgaactaacaataaatgatggtgggtgaaagataaatgttttagggaacagaagaggagcacatatttatgaagcaagaataggtacagtcattttccaactaacatctagtgagactgggattcaccactcagaatgggggtccaccatgagcaacagatttgaggtaccagtgcatagcagctgaatgccagccctgtaaaagaccaccataaagagagctccatgttcttttgctcttttggggatgggacatcaaacaaaagtctcttcgtgtatatctcagctcctgccacatgatcatcacctatctgtgagaggcatcgcttttgctttgtttatttatttttttaatcctcattccctatgtccacttgccttcctctccgaggcaactactctaatgcatttggtatgtaactttaaatttgaatgtattcttgtaaaacatccagtatttttttttctgtgactatgttttcacttacataaaagaaattgtgat

SEQ ID NO: 1370 - DNA, 2842 bp, Homo sapiens
ggcctttctcgtcttttaagggtttttacttccatggggaactatgtgttggatgagaaaagtatccggggaaggggacagaggttcagaaagctctgcgagtcctggacgctggtctgccttcttggctcaccctggaaggtggacgctggccccacacatcccctcttaaagacgcaggccgatagccagcagatcctggggcttgctggccccaagtgagttgtcagggtttcagaggacaccagtcatggcaaccccagctccatggctgccacacaggcctgggcttcccaggactgcctccttcttgttcgcttatgtagatgaaaaatgaggtaacggcactcccctgccccaccctcctcccagaagtgcccagggtgtaaacgcaatagcttgtgtgaagtccactggaacccaggctcaccaagtcagtcttaaccaacacaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccaga

SEQ ID NO: 1371 - DNA, 1128 bp, Homo sapiens
gagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatcctgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggctgcctgaaggggctgcgcctgggccacaagtgcttcctgctctcgcgcgacttcgaagcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatctcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggc

SEQ ID NO: 1372 - DNA, 720 bp, Homo sapiens
ctgatggctgttctcctagtccccaagagttgaaccggagaggcttttactttgcaccaggtcgagaacgtgatcagccctttagagaaggaacctccttgtaacaggaattctgctgggaaacgccgtgtaggcactacctccgaagataagatgcatgtttggagctgtgtaaaatgcccactggctgtttgaaagaaggaaaaggtgactagggttgcaaattaaccttagtatcacttaaaaatattctatctagtcaaatgtacgtaagcaaagaagagagcaccaggatataaaactgccacagcagcttggaagacagatgattcagattttggggactttcttttgcgtgttacatagatttgtttgtcatcatgcagttaagcaggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaagccggcagggatttagcacaagatacaagatatacagaaatatgggacacatttcttgctatctgctactctgggag

SEQ ID NO: 1373 - DNA, 273 bp, Homo sapiens
ctacgcgcgtgtcatgaaccctgccgagagggccggggctgaggccctcaggccgacccggactcttgggcgcggtctcttgagcaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtactt

SEQ ID NO: 1374 - DNA, 3720 bp, Homo sapiens
gtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 1375 - DNA, 4070 bp, Homo sapiens; identical to SEQ ID NO: 930

SEQ ID NO: 1376 - DNA, 1134 bp, Homo sapiens
cgccgcacatgcgccgggccgggccgggccgggggcgcgcgctctgcgagctggatgtccaggctgcgggcgctgctgggcctcgggctgctggttgcgggctcgcgcgtgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatatccctcacagcccccaaaaaatctgcaacccagtttaccggtcgctaccattacctggggggtcgttttgtgccacctgctctggagaagaagtaccagctgaacctgccaccctaccctgacaccgagtgtgtctatcgtctgcagtgagggaaggtgggtgggtattcttcccaataaagacttagagcccctctcttccagaactgtggattcctgggagctcctctggcaataaaagtcagtgaatggtggaagtcagagaccaaccctggggattgggtgccatctctctaggggtaacacaaagggcaagaggttgctatggtatttggaaacaatgaaaatggactgttagatgcc

SEQ ID NO: 1377 - DNA, 1996 bp, Homo sapiens
cctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1378 - DNA, 1004 bp, Homo sapiens
tctctgctgatctgagtctgcctgtggcatggacctgcatcttccctgaagcatctccagggctgaaaaatcactgaccatggcaccatggtctcatccatctgcacagctgcagccagtgggaggagacgccgtgagccctgccctcatggttctgctctgcctcgggaacctctccaaagccaccctctgggctgagccaggctctgtgatcagccgggggaactctgtgaccatccggtgtcaggggaccctggaggcccaggaataccgtctggttaaagagggaagcccagaaccctgggacacacagaacccactggagcccaagaacaaggccagattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcatatcctgcaggtatggtcagaacccagtgacctcctggagattccggtctcaggtgaggaagccacagtcttctctagtacaattcagggaagccagacaggttgtggagagctttacaggcagggcagcccctgctaagaaagacaaaaaggggaaggagaacacagaaatcctagggacacaaattcagggtgaggaaaacaaagcaagggctgggcacagtggctcacacgtgtaatctcagcactttgggaggccgaggcaggtggatcacctgatgtcaggagttcaagaccagcct

SEQ ID NO: 1379 - DNA, 414 bp, Homo sapiens
ggactccacgtcaggctgtctctggtgcgctcgcccctcccctctgaggagatgttatttccctcctttcttctccgaggggtcaagattcttctggaagaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatcca

SEQ ID NO: 1380 - DNA, 1611 bp, Homo sapiens
gtggactctgagaagcccaggcagttgaggacaggagagagaaggctgcagacccagagggagggaggacagggagtcggaaggaggaggacagaggagggcacagagacgcagagcaagggcggcaaggaggagaccctggtgggaggaagacactctggagagagagggggctgggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccaca

SEQ ID NO: 1381 - DNA, 692 bp, Homo sapiens
cctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatggccaactggctgagtgattcgaagaaagtgaggaatcctccctggacactgtatcgcccttcgtcgtctttcagtcaatctcttccactctaaggattgagtgagcgcgagctggggactctctcaaagataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagc

SEQ ID NO: 1382 - DNA, 2589 bp, Homo sapiens
acatttgtgatcacctggtcacacacctgggcaggaggctgcccctcctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggccca

SEQ ID NO: 1383 - DNA, 2305 bp, Homo sapiens
ctcactcacctccgcactgcagccaagggaggcccgccctggcgtgggctgctgcctgtggctttgggcaggcaggagcgaaagggccaggggttgcctgtcctcccccaccctgttgaggccttcctccccctctgctgagcctcggttaattataactctgacctaagtgccctgtgacgtcaagcccgggccagccctgcccaggagacccagcaaccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgaccccgacctgcactttgatgctgagcgactgggtcagggacgcgcgcgcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccgattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctagcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcgagacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaaagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtccacccctag

SEQ ID NO: 1384 - DNA, 2449 bp, Homo sapiens
aataacctcaacgtgggaagtgacaccacatcagaaaccagcttttctctctccaaagaagcaccaagggagcatctggaccaccaggctgcacaccaacccttccccagaccgcgattccgacaagagacggggcacccttcattgcaaagagatttccccagatcctttctccttgatctaccaaactttccagatctttccaaagctgatatcaatgggcagaatccaaatatccaggtcaccatagaggtggtcgacggtcctgactctgaagcagataaagatcagcatccggagaataagcccagctggtcagtcccatcccccgactggcgggcctggtggcagaggtccctgtccttggccagggcaaacagcggggaccaggactacaagtacgacagtacctcagacgacagcaacttcctcaacccccccagggggtgggaccatacagccccaggccaccggacttttgaaaccaaagatcagccagaatatgattccacagatggcgagggtgactggagtctctggtctgtctgcagcgtcacctgcgggaacggcaaccagaaacggacccggtcttgtggctacgcgtgcactgcaacagaatcgaggacctgtgaccgtccaaactgcccaggaattgaagacacttttaggacagctgccaccgaagtgagtctgcttgcgggaagcgaggagtttaatgccaccaaactgtttgaagttgacacagacagctgtgagcgctggatgagctgcaaaagcgagttcttaaagaagtacatgcacaaggtgatgaatgacctgcccagctgcccctgctcctaccccactgaggtggcctacagcacggccgacatcttcgaccgcatcaagcgcaaggacttccgctggaaggacgccagcgggcccaaggagaagctggagatctacaagcccactgcccggtactgcatccgctccatgctgtccctggagagcaccacgctggcggcacagcactgctgctacggcgacaacatgcagctcatcaccaggggcaagggggcgggcacgcccaacctcatcagcaccgagttctccgcggagctccactacaaggtggacgtcctgccctggattatctgcaagggtgactggagcaggtataacgaggcccggcctcccaacaacggacagaagtgcacagagagcccctcggacgaggactacatcaagcagttccaagaggccagggaatattaaagagactgggatgaggtggaggacgctgcctctggttctggagcacacacgtgctgcactgacgtgccgactggcgccgagaccttcatagctgcggtcgtgtatatttgtatataccacatgagtatttctcatacattacgctaggggcgtgtgccacgcccaggggactgccttgtgaagccgccctcgccatctgcagagctccttgaaagtgcccctggggagcgatgtgggcagaaggatggggacaacttggaagccagaagaagaacctggaagccacagtgggtgcgactcaattcacacccggatccagagtttcaaagagaggcaaagggggaaagagactgaggttgtaaacgttataagcagtttttatatataacttatttaatacaaatgtgacttaattaagcgtaaccttttctctggagttgtggtgaaactaatcacgtctgtgagagatcagaaagaaagagacttagggaagtggaagagaaagggaattttggaatttatttctttaaaaataatgcaatggaaatatatcaaaacatgtaaacgcccaccttaaaccaaatgttatttggtcatgaggcaccttgctggagtctcagattccaaaagtctcttcttcagactgggtagggaatatgatattttagggacaaagctgaggactggttttaaataggctttaaaataaaagatcaatattatcataatgctatcattctgctaaacggccccaaaacagtagaatttctgctcatgtcctagcaggttcagaagactgcagccaagttcagatgtaaaaacaagaagtagcacttttccaaaggaaaacaacaaaacaaatgggaaaaagataatggaccgcatttcacctattttaatactattttaacaattttttcatctaccaatatatccccaataaataaatataaaagggggggagggtcaatctggggaatcttagttttttatgttttaagaaaacaaaaaaaactgcattatttttgtaaagtatttattgagtcacggattattgtgcatcaagcaattgttaatatgacctggtcctatggggtagaacttaggaaaaataaagttggttcttattcaatattttactttgcaaaattctagtaaaagagagtatataataaaatcataataaaaggtg

SEQ ID NO: 1385 - DNA, 1800 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaa

SEQ ID NO: 1386 - DNA, 485 bp, Homo sapiens; identical to SEQ ID NO: 1263

SEQ ID NO: 1387 - DNA, 1520 bp, Homo sapiens
taagcaagtgtcagggctcaccaaccatgcaaggacagggcaggagaagaggaacctgcaaaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcatctgtcaacaga

SEQ ID NO: 1388 - DNA, 847 bp, Homo sapiens
gcagctgacgcccgcttattagctctcgctgcgtcgccccggctcagaagctccgtggcggcggcgaccgtgacgagaagcccacggccagctcagttctcttctactttgggagagagagaaagtcagatgccccttttaaactccctcttcaaaactcatctcctgggtgactgactacttggaagatgaactgttctcatcagcaacatgctattatgtcatcttttaggactaggtaatgctccagtgacttaataccaatgacattttcatgttgtccacaaattctgagtagaaaccttttcaagcctgtagcctctctgagagctgactgttattaactgaatgagaggatgtcagcaaacagagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatgg

SEQ ID NO: 1389 - DNA, 886 bp, Homo sapiens
gcttcagtccagcacctttctcgggtcacggcctcctcctggctcccaggaccccaccataggcagaggcaggccttcctacaccctactccctgtgcctccaggctcgactagtccctagcactcgacgactgagtctctgaggtcacttcaccgtggtctccgcctcacccttggcgctggaccagtgagaggagagggctggggcgctccgctgagccactcctgcgcccccctggccttgtctacctcttgccccccgaagggttagtgtcgagctcactccagcatcctacaacctcctggtggccttgccgcccccacaaccccgaggtttaaagccaggtacacgaggcaggggacacaccaaggatggagatgttccaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtccatcccgactcccggggccctcggacaccccgatcctcccacaataaaggcttctcaatccgc

SEQ ID NO: 1390 - DNA, 1484 bp, Homo sapiens
atggtgctgctgctggtgatcctcatcccggtgctggtgagctcggccggcacgtcggcgcactacgagatgctgggcacctgccgcatggtctgcgacccctacgggggcaccaaggcgcccagcaccgctgccacgcccgaccgcggcctcatgcagtccctgcccaccttcatccagggcccccccatggggcccccgggcgagaagggcgagccgggccgccaaggcctgccgggcccgcccggggcgcccggcctgaacgcggccggggccatcagcgccgccacctacagcacggtgcccaagatcgccttctacgccggcctcaagcggcagcatgaaggctacgaggtgctcaagttcgacgacgtggtcaccaacctcggaaaccactacgaccccaccaccggcaagttcacctgctccatcccgggcatctacttcttcacctaccacgtcctgatgcgcggaggggacggcaccagcatgtgggctgatctctgcaaaaacaaccaggtgcgtgctagtgcaattgcccaagatgctgatcagaattacgactatgccagtaacagtgtggttcttcatttggagccgggagatgaagtctatatcaaattagatggcgggaaagcccatggaggaaacaacaacaaatacagcacgttttctggatttattatttatgctgactgataatgcagaaactaagcttattattctgagtttgaacactggattcgtatggctaacgtcagtgaatcaaggatcccaggggatgccaatggcagggcacctcagttgtgtatatgtggggaaatcaaatgctacctgactcacatctgtatcactcagaaacattatgtaaaaaatatcaaagcaagataagcagatgtgtgatccactaccgccaaagcaaatactccttatcgttagtgtccatgtgaatgaagtcctatatagatcacaaatttttatagacaaatctaagacattgaattatttcttctatatatatgatactttggtgtactgtgatcttgctgcttttatccatatgtcagctttggttcttgtgagtttacctgcttattatgatacttggagtccattcatagtgtggggaagaatgatttttgccctgcaggagaaggtctaattgaaataatgctgcttgtccccaaagaaattgtttgccttgtactcttgttaaccttagagctagacctgggaatgattcaacttcaagccttaacctggaattttctggatttgagggaattcccaagcctatgatctttttcacattttctttttcttatatgaattttcttttctctcttttctggtgatagtctttaaaaatagagattgacagtgtatcataggattaccctctaagtgtgaaaatgtgtaattatgtacggtatttagaaaaagcccttatgtgtccattttgtcaactgaatacatttagattc

SEQ ID NO: 1391 - DNA, 580 bp, Homo sapiens; identical to SEQ ID NO: 1292

SEQ ID NO: 1392 - DNA, 1472 bp, Homo sapiens
cttagatattaaactgataggataagatataaaataatttaagattgctgatatatgttttaaaattaattatttgctcaagcatttgtgacaatttacagttctaattgaggttttaaatttagtagtttgtaggtattttaagttttgcccctgaattctttataggtgctgataagcctttggtaagttttactccatgaaagactattactgaaaaaaacgtaatctcaataaaagaactttaataagcttgactaaatatttagaaagcacattgtgttcagtgaaactttgtatataatgaatagaataataaaagattatgttggatgactagtctgtaattgcctcaaggaaagcatacaatgaataagttattttggtacttcctcaaaatagccaacacaatagggaaatggagaaaatgtactctgaacaccatgaaaagggaacctgaaaatctaatgtgtaaacttggagaaatgacattagaaaacgaaagcaacaaaagagaacactctccaaaataatctgagatgcatgaaaggcaaacattcactagagctggaatttccctaagtctatgcagggataagtagcatatttgaccttcaccatgattatcaagcacttctttggaactgtgttggtgctgctggcctctaccactatcttctctctagatttgaaactgattatcttccagcaaagacaagtgaatcaagaaagtttaaaactcttgaataagttgcaaaccttgtcaattcagcagtgtctaccacacaggaaaaactttctgcttcctcagaagtctttgagtcctcagcagtaccaaaaaggacacactctggccattctccatgagatgcttcagcagatcttcagcctcttcagggcaaatatttctctggatggttgggaggaaaaccacacggagaaattcctcattcaacttcatcaacagctagaatacctagaagcactcatgggactggaagcagagaagctaagtggtactttgggtagtgataaccttagattacaagttaaaatgtacttccgaaggatccatgattacctggaaaaccaggactacagcacctgtgcctgggccattgtccaagtagaaatcagccgatgtctgttctttgtgttcagtctcacagaaaaactgagcaaacaaggaagacccttgaacgacatgaagcaagagcttactacagagtttagaagcccgaggtaggtggagggactagaggacttctccagacatgattcttcatagagtggtaatacaatttatagtacaatcacattgctttgattttgtgtatatatatatttatctgtgttttaagattgtgcatattgaccacaattgtttttattttgtaatgtggctttatatattctatccattttaaattgtttgtatgtcaaaataaattcattaatatggttgattcttc

SEQ ID NO: 1393 - DNA, 2407 bp, Homo sapiens
acatggtttagttgatggcgcaagcccaggtccaaagcccatgctcttctcaaacagccagaggtgactcccacacgggtcatgctgttgtctcctgatccagccggccctgccaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcct

SEQ ID NO: 1394 - DNA, 768 bp, Homo sapiens
gggcagaatcagacccagcgtctgactcctcctgagagggctcccttttttctcctctcctccgctgtcagaaacagatctgggctggaatggcctggggtggggtccacacctgctgcttccacctgtgctgctgctgctcctggcctcagggtgctgtgcctgaagaacttcacaaacacccaggacagaccctcctcctgcaatgccagtactcacccaagagagggccctatcagcccaaatcctggtgtcagcagacatctccaagtcggtgtaccttacttgtcaccagctccaagccctggacagcagttcagaagtctcattacacaatctgggacaagcccaatgctggcttcttcaacatcaccatgattcagctgacacagaatgactcgggattctactggtgtggaatctacaacgcttccgaaaacatcatcactgttcttagaaatatcagcctggtggtgtctccagccccaaccacgtctcctatgtggactcttccctggctcccaacaagcacagttctgatcacttctccagaggggacctctggccatccctccatcaatggctctgagaccaggaaatcaagagcccctgcctgccttggctcaggtggccccagattcctggtcttggtgctatgtggactcctcctggccaagggcctgatgttgtgagtcctgttagtgctcctgatctgcaggtgccacagcagtgacgaggtttctgattgtcccagcacagccttgtccc

SEQ ID NO: 1395 - DNA, 534 bp, Homo sapiens
atttatccctaatctggagggcaacctggagctaggtaagaacagaacagccctttgacttcaacgcatggacaaaggacaacaaaggcacactcattctgtctcctgctaccctgtgaaaaggtgccttctgccattattgtaagcttcctgaggcctcctcagccatgtggaactaatatttaaaaaaaccatccatgggacagtctaacataacaaagggaattattcatcaagaagaggccctttagcagggtatttaaagtgcccaggtacttacaataacaagttggactgaacacattgtatctcaggaattaagaatttttcctaaaagaagtttccagattgtttgaacttctctggccgcacaatacaggaaggaagactaaagcagcaaagggacctacagcgtctgcagcatgggctggttaactaggattgtctgtcttttctggggagtattacttacagcaagagcaaactatcagaatgggaagaacaatgtgccaaggctgaaattatcctacaaag

SEQ ID NO: 1396 - DNA, 560 bp, Homo sapiens
gccgctgaagggattctcagtcccatctgactccccatgaggctcctggctttcctgagtctgctggccttggtgctgcaggagacagggacagcttctctcccaaggaaggagaggaagaggagagaggagcagatgcccagggaaggcgattcctttgaagttctgcctctgcggaatgatgtcctgaacccagacaactatggtgaagtcattgacctgagcaactatgaggagctcacagattatggggaccaactccccgaggttaaggtgactagcctcgctcctgcaaccagcatcagtcccgccaagagcactacggctccagggacaccctcgtcaaaccccacgatgaccagacctactacagcagggctgctactgagttcccagcccaaccatgaggacattcctcctcttcctcggaggactgcctacctgtatgcacgcttcaaccgcatcagccgtatcagggccgaagacttcaaagggctgacaaagttgaagaggattgacctctccaacaacctcatttcctccatcgataatgatgcctt

SEQ ID NO: 1397 - DNA, 4481 bp, Homo sapiens
gcgagtagcggagcgggacccgctgatgctcaccccatttagagaaagaaatccacctccccaaccccaatcaagaacctgctattgtatatcatcatagagccagattacctagggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaaccc

SEQ ID NO: 1398 - DNA, 3523 bp, Homo sapiens
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 1399 - DNA, 2127 bp, Homo sapiens
ggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 1400 - DNA, 681 bp, Homo sapiens
tttacggactgcagcttaaaggaaccggcctctgccattgagaccaaactgacagaggaactggtcactcttctgttctttccagagaggagcttagccagggacttctgcccttcctgggcccgggcctcgggggcgattccggcaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatg

SEQ ID NO: 1401 - DNA, 1875 bp, Homo sapiens
tcaccagcctccctcttttgtccaccagcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaagccagggcagccctctgtggaaccccaaccccgagcctggcgtccggcctgtggcgcaccctgcaagtgggctggaacatgcagctgctacccgcgggcttggtgtcctttgtcgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggctggtgtggctgagtgctgccatggggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagatcacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctg

SEQ ID NO: 1402 - DNA, 369 bp, Homo sapiens
agcatagggacgacaggagccaggacccgtgtaggagatggttctcgccatgctgggggctctgcacccccgggctgggctcagcctcttcctccacctcatcctggcagtggcactgcttcgctcccagcctctgaggtctcagcggtctgttcctgaggcattttccgcccccctggaactctcgcagccactttccggcctggtggatgactatggcatcctccccaagcacccaaggccgcgagggcctcgacccctcctgtctagggcccagcagcgcaagcgggacgggcccgaccttgccgagtattactatgatgcacacctatgacccaaggccctcataaagataccatgtgtgacaaa

SEQ ID NO: 1403 - DNA, 3968 bp, Homo sapiens
gaggaactgagaggagaaggagaagagagtgggcccgccttcagggtctggggccttccaggttgggtcgtaggggcgggagcgcacaggctgcgagagaggagcaaaggttggtggagggagaagagcagtctggggcctggctggacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1404 - DNA, 950 bp, Homo sapiens
atgcagaccttcccagttgctggggcgctggaccctgctatactggacacaaggtaggagcactcagaagggacaccgtcatctgctgctgtcgccatggcgattattcaacgccctgcctcttcaccccaggaaaaccttcgcggaacccgtcaccatggaaacgaactctctggactcttagcgcgccctgggctggccctgctgggtggacaggagaggagcaaaacgcaacaaagacgggattaattactcggaggccgcgccccctccgaagaaggccccaccctgccccggcctcacccctccccgaaataattcgaggaaatattccgcgaatgctgggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcacaccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtt

SEQ ID NO: 1405 - DNA, 630 bp, Homo sapiens
gcagaccaggacccacagagacccttgactgggccacaggcatgaactaagagtgctgaagacctaggagaaccactggtcagctgggctgacgctaacaggaggcagtgtgtggctcgaagattcttgaacccacagcagcagctgcggccaccccatcctgcccacagctccagccctgagacgacgaggaggagagtcgactttgcctcttgcccaagggaccatgcccaggtgccggtggctctccctgatcctcctcaccattcccctggccctggtggccaggaaagacccaaaaaagaatgagacaggggtgctgaggaaattaaaacccgtcaatgcctcaaatgccaacgtgaagcagtgtctgtggtttgccatgcaagaatacaacaaagagagcgaggacaagtatgtcttcctggtggtcaagacactgcaagcccagcttcaggtcacaaatcttctggaataccttattgatgtagaaattgcccgcagcgattgcagaaagcctttaagcactaatgaaatctgcgccattcaagaaaactccaagctgaaaaggaaattaagctgcagctttttggtaggagcacttccctggaatggtgaattcactgtgat

SEQ ID NO: 1406 - DNA, 3537 bp, Homo sapiens
ctggtgtgtgtccctctcttcctgggcttccggcctctgaactagaatgtttcaaggcctaggagtgacaggacgtggtcagcaatagtggcccaggtcctgcccttgggtgacccaggccaaggtctcctagttagaacaggacagagtcacgaggctgccactgttgggaagggccctgcctgtgctgactctgcaaatgaggagtcgcccagagccgccgcgaccccacccaggagcactggccagcctggggaagacacaaacccagccccaaaggccccacagccaccaggcacctccaacaaccaggtccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtcgtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatgggctcagaggagcctggcccaccctcttgaaactggtcctggaccttggctcagctctgccgcctcaggtagcacgacccccaggccagcctggacacatcagggagcatggtgaggggcaacggcaggacccgtgggccatatcgggacaggcatttccagcgaggggtggggcagaggacatgtggctggcaggctacacccaccctgccatgcagcggtgtccaggctctggggaggccctggggaatttggaggcatcatgagccaaggcctggtggccctcgttcccctgcccctcgtcaccatcctgtccttggctggccgtgaggactcccctcctcaccactgggtcccacagggctgaggtgggcagtagagggcataggtgggtacatgtcccgggcaaggtctctcggggggacagaagtgagtccagggagtgggtgggcctgggcgtccctcactcagaatgccgtggggtgaggacggtgaggacagggtgggcactgggttctggtttagagtcagtaatgttagggcgcagtgggcagggggtcaggacatctccagccggtggtgaggaagcatggtggggtctcctccacaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaagacatggtggcatgtgcctgtactcctggctactcaggaggctgagatgggaggatcgcttgatgaggttgaggctgcagtgagctgtgaccgactgcactccaaaaaccttgtctaaaaaaacacaagctgccactggctttggggcactgaccttgtctccccagaggtgctgacgctaacattcaagttgttctcgggggtcctgtggcttctgttggagtgagggtgggggacacgcaggtctgggagggtggtgtgggcctggagctaggcattgccagatcagcattgggtggaggcaggggtggggatgccacacaggatgggatgtctagagcgggctgtgtctcccggggggatgggcagagggtggggcaggaattagctggaaatgagattgtggggtgcagtttggggatcagatgccccaacctgaactgaccgtcatccctgtggccagggtccccacacaaccctcacccctggctgtgagaatcctgaggcaccttgatgcattttttttcatgccctgtg

SEQ ID NO: 1407 - DNA, 950 bp, Homo sapiens; identical to SEQ ID NO: 1126

SEQ ID NO: 1408 - DNA, 2072 bp, Homo sapiens
agccacagagggccaataaatggccccttctgaatgaggtgcccctgcacctctgcagagcctgctgccagcctccaggatctaactgggctctgattcaccgctcccaaccccacatccagctctatccatagatgaaacacgggcgcatctgttgttgaaagaaaagatgatgcggctgggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctgtctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcgcgagtagttggaattataggcatgtgccaccacacccagctg

SEQ ID NO: 1409 - DNA, 1996 bp, Homo sapiens; identical to SEQ ID NO: 1377

SEQ ID NO: 1410 - DNA, 950 bp, Homo sapiens; identical to SEQ ID NO: 1404

SEQ ID NO: 1411 - DNA, 1335 bp, Homo sapiens
gtcaccggcccggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgc

SEQ ID NO: 1412 - DNA, 1111 bp, Homo sapiens
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaaggaccagagaagctctcgcatcccgtgac

SEQ ID NO: 1413 - DNA, 873 bp, Homo sapiens; identical to SEQ ID NO: 1159

SEQ ID NO: 1414 - DNA, 1347 bp, Homo sapiens
tctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactccgctccctgtgtccccaatggctctggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatttttggggggagagacacagatttttacactaatatatggacctagcttgaggcaattttaatcccctgcactaggcaggtaataataaaggttgagttttccac

SEQ ID NO: 1415 - DNA, 485 bp, Homo sapiens; identical to SEQ ID NO: 1263

SEQ ID NO: 1416 - DNA, 1996 bp, Homo sapiens
cctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1417 - DNA, 4070 bp, Homo sapiens
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 1418 - DNA, 1408 bp, Homo sapiens
ggcaatctgttcaggtcgttttccatagtgtggaagctttgttctttcgctctttgcaataaatcttgctgctgctcactctttgggttcacactgcctttatgagctgtaacactcaccacgaaggtctacagctttactcctgaagccagcgagatcacgaacccactgggagaaacgaacaactccagacgcactaccttaagagctgtaacactcactgcgaaggtccgcagctgcattcctgagccagcgagaccacaaacccaccagaaggaagaaacttcgaacgcatccgaacatcagaaggaacaaactccagacacgccgcctttaggaactgtaacactcaaccgcgagggtccgcggcttcattcttgaagtcagtgagaccaagaacccaccaattccggacacactgggattacaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccggtgatcttgatagtggacaaagtgctcgagacccaggacctgaatggggatgggctcatgacccctgctgagctcatcaacttcccgggagtagccctcaggccttacccaccctatattggagttggccccaattccaatatgtgttccagatcggacctccctgaggacagcaacactctgtatcctgggtcacatttgtggctgaggcacgcccttaattccaagggcaacctggacgccaggctggatggaggggagaaggcgatgcagccgcaatggtagtctccatggtgtgtgaggagccggcacctgctctcacacgatgccatcaaagccctgcaggccacacttcttgccggccacctggcacccgaatctcagtgcttcctgcacgctcctccctggaggaggggcaagtagctaggtcagccaggtgtttggggcagggacaggtcccagtccttttcccctcctgctgccatactcaccctgggagaggctgaagatgacggaggcattgaaggtgtctccagctcccagtgtatccaccacgcggggtggcgggaaagcatccgagtggagcaatttgccatcagggcccagggcgtcggcgccctcctcagcccaggcacagacaagcacagccctgcaagacggctccactcagctgggtgttagcccaccccgtccccccagccatcctcccagctcca

SEQ ID NO: 1419 - DNA, 2881 bp, Homo sapiens; identical to SEQ ID NO: 811

SEQ ID NO: 1420 - DNA, 3857 bp, Homo sapiens
tgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 1421 - DNA, 922 bp, Homo sapiens; identical to SEQ ID NO: 819

SEQ ID NO: 1422 - DNA, 1038 bp, Homo sapiens
ccgcagctgcgcggagcgccgggcacggatggcggcggctgaggggagcgaagcgagggagggagagcaagctaagaaacacccagcaggtgctcccccgcctaggcctggctggaggctactggcgccaccctgggggccctgtcagccaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctgg

SEQ ID NO: 1423 - DNA, 560 bp, Homo sapiens; identical to SEQ ID NO: 1070

SEQ ID NO: 1424 - DNA, 3832 bp, Homo sapiens
ggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1425 - DNA, 2419 bp, Homo sapiens
tagaagggagcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctttctacgtcttaaggcagagaatagccaggataaggtgccagctcaaagctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcattccacggcaaccttcaaatgacttgtttgaaatatttgaaatagaaagaggagtcagtgcagacgatgaagcaaaggatgatccaggtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtg

SEQ ID NO: 1426 - DNA, 2757 bp, Homo sapiens
gtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctgctccatgcttcactcagctccccgggaggagaagatgcctggctcataggggtggggggctctgtgccctcaggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaactaagaaaa

SEQ ID NO: 1427 - DNA, 2143 bp, Homo sapiens
aggcggggtcacgcggaaggccgggcagcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataagattgaagagcaatcagattgtaagatcttagatggacactttgtttcccccatggctcactatgtgcctgatatcatgccaattgaatctgttattgcaaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgttactgtttatgaaaaactaaatttttaatcatgaataatttattaaattaaataaatttattcatagaaacttttctgggttttagtaaaattgctaaatcaaaccaagattttaatatatcagcatttactttgtacccttataacatttcactcttgacttgatttgagaaacatgtttattttttgaatgttcttgtgttcaactaattttctgctgtggaaataaatacttatgatatat

SEQ ID NO: 1428 - DNA, 3942 bp, Homo sapiens
agattccccagctgctgttctctggaggggttcctggggcggagatgtgcagtggagcgagaacttcctgtgaccgtgacattgtctaggtggaaccgatcccagaagtaggaggggcgtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 1429 - DNA, 451 bp, Homo sapiens; identical to SEQ ID NO: 931

SEQ ID NO: 1430 - DNA, 3678 bp, Homo sapiens; identical to SEQ ID NO: 1076

SEQ ID NO: 1431 - DNA, 3362 bp, Homo sapiens
gaggggttgcccatgtgctgcatttctctgccggttgtttgaatgtgctctgctttccctgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaaggtgaagttttgctcttgttgcccaggctggagcgcaatggcgcgatcttggctcaccgcaacctctgccacccagagtcagttttcagataagccggtgcaagaccggggtttggtcgtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatgggctcagaggagcctggcccaccctcttgaaactggtcctggaccttggctcagctctgccgcctcaggtagcacgacccccaggccagcctggacacatcagggagcatggtgaggggcaacggcaggacccgtgggccatatcgggacaggcatttccagcgaggggtggggcagaggacatgtggctggcaggctacacccaccctgccatgcagcggtgtccaggctctggggaggccctggggaatttggaggcatcatgagccaaggcctggtggccctcgttcccctgcccctcgtcaccatcctgtccttggctggccgtgaggactcccctcctcaccactgggtcccacagggctgaggtgggcagtagagggcataggtgggtacatgtcccgggcaaggtctctcggggggacagaagtgagtccagggagtgggtgggcctgggcgtccctcactcagaatgccgtggggtgaggacggtgaggacagggtgggcactgggttctggtttagagtcagtaatgttagggcgcagtgggcagggggtcaggacatctccagccggtggtgaggaagcatggtggggtctcctccacaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaagacatggtggcatgtgcctgtactcctggctactcaggaggctgagatgggaggatcgcttgatgaggttgaggctgcagtgagctgtgaccgactgcactccaaaaaccttgtctaaaaaaacacaagctgccactggctttggggcactgaccttgtctccccagaggtgctgacgctaacattcaagttgttctcgggggtcctgtggcttctgttggagtgagggtgggggacacgcaggtctgggagggtggtgtgggcctggagctaggcattgccagatcagcattgggtggaggcaggggtggggatgccacacaggatgggatgtctagagcgggctgtgtctcccggggggatgggcagagggtggggcaggaattagctggaaatgagattgtggggtgcagtttggggatcagatgccccaacctgaactgaccgtcatccctgtggccagggtccccacacaaccctcacccctggctgtgagaatcctgaggcaccttgatgcattttttttcatgccctgtg

SEQ ID NO: 1432 - DNA, 582 bp, Homo sapiens
atttccctcctttcttctccgaggggtcaagattcttctggaagaggtgcccccttaaaggagcaggagccttggctggggtcctccttgtctcctgagtatcttgtgtgaggtgcaggggatacagtctaattgcagaagctcctcattcttcggggacctggatggggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaa

SEQ ID NO: 1433 - DNA, 801 bp, Homo sapiens
tctggagcccacacccaacatggttggtgactgggagacagaaaaggatagaaaaaaaaaaggctcaggaagacaacaattcaagtcctacccttgtgtgtgcatctcaaggctgtgttcttttaaagaaggagaattctttgaatttcttaaatccgatgtgatggtgaactgcaggcttcggttttcatcatgctgagtcctaacatttgtgactacttcccccggggtggccatgtgaagcatcttatgcgcatgagcctattttatcctcccaacaatattaggaggtatcctcggtccgttttacagatgctgaagatgacccaggttgatacagttaagcagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagttta

SEQ ID NO: 1434 - DNA, 1903 bp, Homo sapiens
gactttggttactgtcctcgtgtgtactgtgagaaccagccaatgcttcccattggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 1435 - DNA, 3156 bp, Homo sapiens
tctaatgcacgacagattcctttcagacaggacaactgtgatatttcagttcctgattgtaaatacctcctaagcctgaagattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcatcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaagaaaatagaaatacaggaatagtattcggggccattttaggtgctattctgggtgtctcattgcttactcttgtgggctacttgttgtgtggaaaaaggaaaacggattcattttcccatcggcgactttatgacgacagaaatgaaccagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaacaatgaagatgactctttactgctctgcctgaagccctagtaccataattcaagattgcattttcttaaatgaaaattgaaagggtgctttttaaagaaaatttgacttaaagctaaaaagaggacatagcccagagtttctgttattgggaaattgaggcaatagaaatgacagacctgtattctagtacgttataattttctagatcagcacacacatgatcagcccactgagttatgaagctgacaatgactgcattcaacggggccatggcaggaaagctgaccctacccaggaaagtaatagcttctttaaaagtcttcaaaggttttgggaattttaacttgtcttaatatatcttaggcttcaattatttgggtgccttaaaaactcaatgagaatcatggtaaaaaaaaaaagttaaccaaagaatatacctgtacataatttgtacagttttaagttgttagataggaactggatttcttatgtattagacattattgctcaatcataatggaatagattctgcatccctaaatgtatgaaccataaggttaaaaaagatgaatggaaatatcaaacaactttttactgagcatcagtttcataatcaataatataagaagattaatttggattctagtatgtttcagtttgtttttaattaccaccttcctttggtagaaaaaatatgttccttgatgtaggaaagtctaggttttagagattagaggatgagatcaagagttaaattcctaaagaagcactgaatatatgaagagagcaaacaaatcaagtaccaacctagaggctttatttttgaattgattcatggtgtgtgtgtgtgtgtgtgtgtgtgtgtgtgtgtgtgtgtaacacagaaacagcttcagaaaataagggatagaaagtaatgaagaaagtacttaccccatattgccataaaaatagcaaagaagactgtccctccattatcgaacaaatatgtcacctgagtagaaaacaaacagaaatattagtcatgcaaattgattataataagccagtgaatactgtttgcactcaggtactatgattttttctcaaatagaatcatattattttatagtacagaaatattatatatgaattcctttcatgggtcttgcaacaatttcacatgatttttctcatggggagaggtgaagaaacaacattagccctcttctctcctctcttgattccctttataccccaccatcatttctgattataaataattctaccattctatggaagtatttgtgggtcacagattgtcaaactacttaatgaaagttgtatgaaattagtttttcaggtgaggcattcctagttgcaattcctgttagcaaaacttctaggagtggggaagttggaaaatgcaggattcttccagtgagccagcatttcccatagctaaccctattctcttagtctttcaaaatgtagaatgggtccaataatggctataagatgtaataaatcccatcttaatttgttttaaaagtttcataaatcactgaacacttatgaaacaaagtgttttttaatcagatatcaactgaaacttcataaaggatgcatagttttataatgttattgaatcaaattttaaggcttgtattgtttgattttaataaagtataaattcaattt

SEQ ID NO: 1436 - DNA, 989 bp, Homo sapiens
acatgggccctgctggctgtgccttcacgctgctccttctgctggggatctcagtgtgtgggcaacctgtatactccagccgcgttgtaggtggccaggatgctgctgcagggcgctggccttggcaggtcagcctacactttgaccacaactttatctgtggaggttccctcgtcagtgagaggttgatactgacagcagcacactgcatacaaccgacctggactactttttcatatactgtgtggctaggatcgattacagtaggtgactcaaggaaacgtgtgaagtactacgtgtccaaaatcgtcatccatcccaagtaccaagatacaacggcagacgtcgccttgttgaaactgtcctctcaagtcaccttcacttctgccatcctgcctatttgcttgcccagtgtcacaaagcagttggcaattccacccttttgttgggtgaccggatggggaaaagttaaggaaagttcagatagagattaccattctgcccttcaggaagcagaagtacccattattgaccgccaggcttgtgaacagctctacaatcccatcggtatcttcttgccagcactggagccagtcatcaaggaagacaagatttgtgctggtgatactcaaaacatgaaggatagttgcaagggtgattctggagggcctctgtcgtgtcacattgatggtgtatggatccagacaggagtagtaagctggggattagaatgtggtaaatctcttcctggagtctacaccaatgtaatctactaccaaaaatggattaatgccactatttcaagagccaacaatctagacttctctgacttcttgttccctattgtcctactctctctggctctcctgcgtccctcctgtgcctttggacctaacactatacacagagtaggcactgtagctgaagctgttgcttgcatacagggctgggaagagaatgcatggagatttagtcccaggggcagataa

SEQ ID NO: 1437 - DNA, 730 bp, Homo sapiens; identical to SEQ ID NO: 1166

SEQ ID NO: 1438 - DNA, 460 bp, Homo sapiens
ttgccggggtgaggggcagccggaggagtccgagaggaagcggaggcgcgagctggaggcggcggctcccgtcggcctccggcaggactgagcgctgggaggccggaaggcgggcgcgcgcggcggagaggcgggcgggaggccgctcgggaccacggatgatgattagtggccctagatctgaatatgagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagca

SEQ ID NO: 1439 - DNA, 1220 bp, Homo sapiens
cacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctggacttgagtgagaacgccatccaggccatccccaggaaagcttttcggggagctacggaccttaaaaatttacagctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgca

SEQ ID NO: 1440 - DNA, 882 bp, Homo sapiens
gggggttgtacagaagaggtccggtttcttgaagcagctggaagtcctggatagttcccacctgaaagtctgtttgcaaaggcaatgcgcactcaggcaccagagggcagaggacagaagcttttcctcaaaggtgcaaaaggagcaactgtgttgaacaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgtggtgtttccgtaccaacccagccggggccggtaccagttcaattactacgaggcgaagcaggcgtgcgaggagcaggacggacgcctggccacctactcccagctctaccagg

SEQ ID NO: 1441 - DNA, 736 bp, Homo sapiens
ggtgagcggcagtagccggttatgacgactccctcctctggaacagccgccgtctcctccgcctcctcctcggtagttcacggctgccccggctccaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagttttagagacctgaaacatcacagaagcttctgagtggttctgaagattcaagaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgc

SEQ ID NO: 1442 - DNA, 5859 bp, Homo sapiens
atgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctatag

SEQ ID NO: 1443 - DNA, 1344 bp, Homo sapiens
gtaaaatgtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggcaagtgctcacgtgtgattgaatctaaaccttctgagtccatgaacacgcgacgtgttttgggagatagcggagaaattaacatcttaaccggtcaagctccactggctctggcaatattttaacagatgccaggaacatgggcacagaaatcaatgagatcagatggctggggctgaagaatgaaagctttattttttgtttttgcaattccgagattgtgtctctatatttgtgtcattttcattcagattgactgttgccttgagttttaatgtattgttgctttagaaaatgacatgacattctgtccggaaatgtttcctggcagctaaaaggaaaaagctgtatctacttagatatgaaatgaagagaagcaaagagaacgaggtggtttatgtgataacagcaagctgctcatccaaataacccaggccaaaaatacactgtctacaaggttgtgccaactcagctttcatgtgaaccacaaaagggagtatcggtagacctcaggccaagaaaatacctttttccaggtttctgtgttaaatcaagaactgtactatgcattattgtatctccagaggtgttttgatttcccacacaaagagaaactgtgagtcgcttta

SEQ ID NO: 1444 - DNA, 2727 bp, Homo sapiens
cagctgcctgcctgccaggggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaag

SEQ ID NO: 1445 - DNA, 2115 bp, Homo sapiens
gactttgagcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataac

SEQ ID NO: 1446 - DNA, 1417 bp, Homo sapiens
gtgcgcggcgggcgcgcgcaggctccgtaaccgaaccctgagccgcctgcgcggatcggcgtccgcagcgggcggctgctgaggggaaattcacgttacctctccacgtgccgaccaaggctctgagacccccagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccaggacccagaataaagccaatgatttacttgtttcacctgg

SEQ ID NO: 1447 - DNA, 387 bp, Homo sapiens
actaggcagaggccgcccgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgagccaaagaatttagaacgagtctacgtggacacgcaagtttcagcgagcgggga

SEQ ID NO: 1448 - DNA, 969 bp, Homo sapiens
gctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctggcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgag

SEQ ID NO: 1449 - DNA, 451 bp, Homo sapiens
ggggtgtagaaacaggcctgttaaggagaggccaccgggacttcagtgtctcctccatcccaggagcgcagtggccactatggggtctgggctgccccttgtcctcctcttgaccctccttggcagctcacatggaacaggaccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccaggcttttgggccggggatgcaggaggcaggccccgaccctgtctttcagcaggcccccaccctcctgagtggcaataaataaaattcggtatgctgaattcaa

SEQ ID NO: 1450 - DNA, 1155 bp, Homo sapiens
ccggccctccgccgccgcgcacgtgagcggcaccaggaagctggctgggcgcagccttccctgaggctcgctggcaccggccgcacgcgtccatcccgggcctctgagcggagggggagccgaggctagagggagggcgcagtctgcccaaggtcagcggcagcggcagtttctgggcgccaagtgtgattggagtactccaggaagaggggcgtgaccagagctctagcgaagagacctgacattgtaaagctaggtttggcttctgatttccacagggggtttgagaatgggacgagggtgctttagagggaccggtaggctttccctgaggacggtaatcagggcatgatggttggctcagtggttatttcctgggcaggggtgactgttctttcagctcccagcactggagcgctcggcccctgccgcactggatgccagcagttactaaaagtgagcctggcatttcagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcac

SEQ ID NO: 1451 - DNA, 730 bp, Homo sapiens; identical to SEQ ID NO: 1166

SEQ ID NO: 1452 - DNA, 568 bp, Homo sapiens
actgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagttattcaatctcctgagcctaacagcaatgtagaaacggaactttttgcttttccaaaagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacag

SEQ ID NO: 1453 - DNA, 2734 bp, Homo sapiens
accaattgggacatcacatccctggctctgggttagaaagctgacagtccttgatcctgtggccactgccccatcattcctgctcctgaggactcagtctcatggctgtggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcaggactgagggagctggccgtgcgactgggcttcgggccctgtgcagaggagcaggccttcctgagcaggaggaagcaggtggtggccgcggccttgaggcaggccctgcagctggacggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcacggtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaatgtg

SEQ ID NO: 1454 - DNA, 2240 bp, Homo sapiens
gcagttcccgggcgaggcagttgactgccccacaacgagctcgggcctcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccggaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcaggtggggcccggctttgcagtgggcacagtgggggggccacttctcagaggttcagctctacagccttagcctgtgctcccagcagaatccagttccccatgggcttagctgggctttcccagtgccctccgccactctcagagatgacattgtcattccgcctggttgatttccctttggacattctcagcaaattctgggctcagtctttttgatcgccacttctttgtggaagccctgccaggtcaagaagttttccctcttttgtggtgaggaggacacaggcctgggaaaaataggaacagagttcttgtcctttagtcccagctctcagaatcctcgctgtgtttcctcaggcagcatggctccgcctctctgagcctctgtctctgcttctgaacagcggggccaataatgatgccccgatgccttcctggaagttcagtgagggaaagtcagttgagggacacaaaagtgttttgtaaactataaagtacgtggcatgtgtaggtgaattacaggggccatggatgtggacaccatggagggggaagtggagcgttttcagtggagttggctcctccccgcactgagccatgttcctatgtcaggtggcagcggggaagcgagggtccaatcctgccctgcgctagtcctcatctgagtctcagcctgggtcccccatggttttagcaacacgggtggcaagcagatcaaccaggtggcattggaggcgtggcgcagccggcgggaccgcgaggagatcctcctgcaggagctggagccggtcatctcccgcgcggtgctggacaacccgcaccgtgagtctggctcagcagccccctcccgggcagcttcaccccacacccaggggccaggctctcccggggtctcatgctttgcccactgacccggcagttctgagcctggctttggcactcccagctttgtgactttgggtgagccttacagcccctgagtcctacacccagaaggcggctgagggaactgaggccagcatttttcctcctgcccctgggggtttggggccggcttctcccctcttgtgaagcacaaagtcccctccccacctacccttcctgcagatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggacc

SEQ ID NO: 1455 - DNA, 444 bp, Homo sapiens
catatttgtgctccttcacgggagggcagggaggttcaacggaccttaaaacatgaaggtcttttttctgtttgctgttctcttttgtttggtccaaacaaactcaggggatgttccaccgggaattagaaataccatctgccatatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttcctta

SEQ ID NO: 1456 - DNA, 1248 bp, Homo sapiens
aatgccgctttctgtttcctctgcctcccttcatctccttttgtctggggtttctttgtctggggtctccctttggttctgtttcacagttctcagcctcccctccctttctccacagccaggctgctcagtccctctctgcgggggcctagaggctcggtgaggggagcgggacttggttgccatggtcacattgaagccagccgcagctggcccgggcagctgctcctcctgggcccggggccccggacgctcggacaaagccaggcagcgttggcagccccagacccgaccccaaaggcctgagactggggtgactgggacctaagagaatcctgagctggagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactg

SEQ ID NO: 1457 - DNA, 858 bp, Homo sapiens
atgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaattggccgggtcttccgctttctcggtgacagttcgctcccttcagcattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctag

SEQ ID NO: 1458 - DNA, 1794 bp, Homo sapiens
aactgcttctctctctctcttttactcttattctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctgggctttccagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactag

SEQ ID NO: 1459 - DNA, 1514 bp, Homo sapiens
aagatccagttcttataggactattcatcaggttgtttagttcagcattactttgtgctttctgataagatatgatccaaaacctgatgagagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaatagctgattggcaaaatatcgtcatcttgacaatatttgctctatatcttatgtcttttctgttttaaactgtgcctgtagtaatagatatctgtcttgatgaataagtaaaattaggtatgcatttgtttccattccttctgtatgttttag

SEQ ID NO: 1460 - DNA, 584 bp, Homo sapiens
gatatcacaatgatatggtttggctgtgtcccctctgagaagagggctaccatcttccagttaaattggactttaactagaagtccaattaaacctctttttgttcctagtttcaggtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatg

SEQ ID NO: 1461 - DNA, 609 bp, Homo sapiens
acacacacacccctccacttcaaggtatagccaagagcttctggagccgtcaaaaaggtctgtacctgctgtctttagagcttccagtttgcccttggtcaagaaatactgtttgctaggctctgctggagtacatcagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactg

SEQ ID NO: 1462 - DNA, 1663 bp, Homo sapiens
gcggagcgggacccgctggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaa

SEQ ID NO: 1463 - DNA, 592 bp, Homo sapiens
aactgcttctctctctctcttttactcttattctttctctctcactctctctcttttcccacccttaagccaagtacagggatagttgtctcatcattggtggcttaaaatgatgtttttgaacaagaagacgccccatgggtacttttggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaat

SEQ ID NO: 1464 - DNA, 954 bp, Homo sapiens
agaaataggagcgcgcaggcgcgacgtgcggctcgcagaacggcgagtagcggagcgggacccgctggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaag

SEQ ID NO: 1465 - DNA, 690 bp, Homo sapiens
gttgcgtcatttgtcctggcaactactggcagattctttccaacctcgaattctgctcagctcgctttggcagcttggtgggcggtgggcgcgggtggcggaggcgattgaagctgctggcccagcatgtggtgcgcgagcccagttgctgtggtggccttttgcgccgggcttttggtctctcacccggtgctgacgcagggccaggaggccggggggcggccaggggccgactgtgaagtatgtaaagaattcttgaaccgattctacaagtcactgatagacagaggagttaacttttcgctggacactatagagaaagaattgatcagtttttgcttggacaccaaaggaaaagaaaaccgcctgtgctattatctaggagccacaaaagacgcagccacaaagatcctaagtgaagtcactcgcccaatgagtgtgcatatgcctgcaatgaagatttgtgagaagctgaagaagttggatagccagatctgtgagctgaaatatgaaaaaacactggacttggcatcagttgacctgcggaagatgagagtggcagagctgaagcagatcctgcatagctggggggaggagtgcagggcctgtgcagaaaaaactgactatgtgaatctcattcaagagctggcccccaagtatgcagcgacacaccccaaaacagagctctga

SEQ ID NO: 1466 - DNA, 2099 bp, Homo sapiens
ctctctctcttttactcttattctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggtgggtgggggagcagggcgttctgtcgataaacgagctcccttctttgcacacatagccagttaatcggccattctgagatagtttggatggggagggggagcttctgagaatcgccagtgacagctttaccaagccaattcactcaagttgtctcatctataccccttcaaaccctgtgaggtagggaggggagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggc

SEQ ID NO: 1467 - DNA, 628 bp, Homo sapiens
agaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattgggggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctg

SEQ ID NO: 1468 - DNA, 1518 bp, Homo sapiens
aaaaaaaaaaaaaagaaaccacagcagctgtggctggggagcccagatgaagtgtggctctatcttgtatgtgagcacacccacattttcactgccattatctgggacagcagaaccaggtttggctcaacagatttctctttccacccatctattgcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcaacaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgctccagta

SEQ ID NO: 1469 - DNA, 743 bp, Homo sapiens
tgaataatcagaagtcagtttgggaagatccagttcttataggactattcatcaggttgtttagttcagcattactttgtgctttctgataagatatgatccaaaacctgatgagagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaa

SEQ ID NO: 1470 - DNA, 1331 bp, Homo sapiens
gagctctctgtggaaaactctattttgaaaatgaatatattttgatttaaacaatacagagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaata

SEQ ID NO: 1471 - DNA, 445 bp, Homo sapiens
ctgctctggcaatgcccggtgagactgaattatgtttaaatttattgtagatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatctgcgtggactggaagaagggctcccaagccac

SEQ ID NO: 1472 - DNA, 1870 bp, Homo sapiens
atgaaggtccatatgcttgtaggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctggtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 1473 - DNA, 1444 bp, Homo sapiens
gccgggccacttgtcttcatgtctgccagggggaggtgggaaggaggtgggaggagggcgtgcagaggcagtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgagggggtgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcaaggccagggtaggtgggggccgggagggacccaggtgtgaacggatgaataaagttcaactgcaactga

SEQ ID NO: 1474 - DNA, 936 bp, Homo sapiens
gcggcctggcgctgcggcgaccgaccggggcgtcaggatccctggcccccggagagcgaagggcgggcgggtcccggaggcaccttcactaacccggtgcggagcacttggcgacgcctccctgcccatctcatatctctcggctcatcgctgctctgggcaccagctgcctcttggctggcgctgctgtcacacggtggactgttctggccttactgagctgccgtttggggacatcagattcaggtcgtatggggagaaacgagtgtaactttacaagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccag

SEQ ID NO: 1475 - DNA, 1829 bp, Homo sapiens
agtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgagggggtgcacacagggaccactccaacagagccaggactatatcaacctcttctgcgccaacatgatggacttgaaccgcagagctgaggccatcggatacgcctaccctacccgggacatcttcatggaaaacagtgtaactgggcatcctgtattttacctgccactgtgtgacagtttcctgcccccaaaggctgccccagtgacggagctctacacagatggaccagtcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagattctcgctctgttgctcaggctggagtacagtggcgcaatctcggctcactgcaacctttgcctcctgggttcaagcaattctcttgcctcatcctcccgagtagctgggactacaggagcgtgccaccatacctggctaatttttatatttttttagtagagacagggtttcatcatgttgctcatgctggtctcgaactcctgatctcaagagatccgcccacctcaggctcccaaagtgtgggattataggtgtgagccaccgcgtctggctgaaaagcactttcaatgagactgtgttgaataaagggccaaggttcttgccacccagcactcatgggggctctctcccctagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcaaggccagggtaggtgggggccgggagggacccaggtgtgaacggatgaataaagttcaactgcaactga

SEQ ID NO: 1476 - DNA, 1940 bp, Homo sapiens
tctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgaggctgggctttccagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggc

SEQ ID NO: 1477 - DNA, 1837 bp, Homo sapiens
ttttgtagctttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataagaggaattaatcaagcaatggtcaagataaatggagttggccttgatcgctcaggtgtttatgtacaagagttttccagcaagcgtattttagttgtaacattccagtgaataatcagaagtcagtttgggagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaatagctgattggcaaaatatcgtcatcttgacaatatttgctctatatcttatgtcttttctgttttaaactgtgcctgtagtaatagatatctgtcttgatgaataagtaaaattaggtatgcatttgtttccattccttctgtatgttttagaaaatctatatgcatctaaaaccttgagcgtacgtaaaatattaccattcatatgttagaacaatcctgtctataatatcttaaataccaaattcttgtcttagatagcaaatttattattccct

SEQ ID NO: 1478 - DNA, 757 bp, Homo sapiens
gaaaccacagcagctgtggctggggagcccagatgaagtgtggctctatcttgtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctg

SEQ ID NO: 1479 - DNA, 1872 bp, Homo sapiens
ccgtcatccccctgcagccacccttcccagagtcctttgcccaggccaccccaggcttcttggcagccctgccgggccacttgtcttcatgtctgccagggggaggtgggaaggaggtgggaggagggcgtgcagaggcagtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgagggggtgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagattctcgctctgttgctcaggctggagtacagtggcgcaatctcggctcactgcaacctttgcctcctgggttcaagcaattctcttgcctcatcctcccgagtagctgggactacaggagcgtgccaccatacctggctaatttttatatttttttagtagagacagggtttcatcatgttgctcatgctggtctcgaactcctgatctcaagagatccgcccacctcaggctcccaaagtgtgggattataggtgtgagccaccgcgtctggctgaaaagcactttcaatgagactgtgttgaataaagggccaaggttcttgccacccagcactcatgggggctctctcccctagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcaaggccagggtaggtgggggccgggagggacccaggtgtgaacggatgaataaagttcaactgcaactga

SEQ ID NO: 1480 - DNA, 3450 bp, Homo sapiens
gaataataacttttagatctgtacagataccccttttttctgtaggggaaaacaagatcattggatcattgaactaaataattataatagtttttaagaaaaataacatttggagcttttatctttggtttatattttttcacttatatcgctgtttataaagttttgaccttcagccaaggtctgagagtgatttaccatgttgaagttcatgtatttaaatagactatttaaattactgttttttattagtaaggaaaaggaaacgttcctatgcccactcctcccactatatcatgtataactctcttgcctgtaaaattgtactcttaatttctaatgtttttctttacttcattttcagtatctttaacctttatatcatatgcatatttttgtttcagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacgatattataaagctgtggaagttttttcca

SEQ ID NO: 1481 - DNA, 2014 bp, Homo sapiens
gatactttagagcggagggatgtattgaaacagactactgctacttacagcaccgtatagcagccctgctcctacattttgctgccttactctgccccgaatgcactggagtggggatggtccatcggcaactataaactgattctcatcaggaaactgcacattatctccccatcacttcaaaggtctcgtcaggcagaggtgacgccaggagatgatttaaaggtgaaaatgacaaggtttccacccctcaaaccttggctccttttctgacaatacagtctgaatgaacccgatgtctttttttttactgtggaaataggatcggaagagagtaacatttttttttttttaatcctgataaagaagattgttgggaagctctttgaaaaaaaattttaaattgtggcacagatggattttaaaaagtgttagatctttccaatgaacactaatagagtactctgctcttggctggatttttcagagaatggcaatggtctctgcgatgtcctgggtcctgtatttgtggataagtgcttgtgcaatgctactctgccatggatcccttcagcacactttccagcagcatcacctgcacagaccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatgcctccatagtgattgggaaatggtggtgtgagatggagccttgcctagaaggagaagaatgtaagacactccctgacaattctggatggatgtgcgcaacaggcaacaaaattaagaccacgagaattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatataatattttgaaatattatctattctcttcaagaaatgaacagtaccacagtttgagacggctggtgtacccctttgagttttggatgttttgtctgttttgctttgttttgttagtcatttctttttctaacggcaaggaagatatgtgcccttttgagaattcaagatggcactgacacgggaaggccagctacaggtggactcctggaatttgaggcatcataatgatactgaatcaagaacttccttctgcttctaccagatggcccaaggaagcacatcgtcctgttttattgctttctaccctgtgcaatattagcatgcaagcttggcttacatagtcatactttatattcaattgatatataataaccgttctaacctcttccaggaaaatatttttagaactactagcttttccacttagaagaaaatgaggattcttaagggagccactccaccatgctattaagactctggcagagttatgggtaggatatggatccctacatgaataagtcctgtaaatacaatgtcttaaggctttgtatagctgtcctagactgcagaaatgtcctctgattaaatccaaagtctggcatcgttaactacatagtgctgtagcaacaagtcttatcatggcatctctttctatgtttggtttgctttttccaagagtattcaggtctcctcttgtgagataggaaggccatgaaaacaattagatttcaagatgatctatgtgaccaaatgttggacagccctattaaagtggtaaacaacttctttctaaaccta

SEQ ID NO: 1482 - DNA, 1870 bp, Homo sapiens
atgaaggtccatatgcttgtaggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 1483 - DNA, 1870 bp, Homo sapiens
atgaaggtccatatgcttgtaggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 1484 - DNA, 2673 bp, Homo sapiens
cgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgacc

SEQ ID NO: 1485 - DNA, 451 bp, Homo sapiens
gggaccccatttctgtgctcatctgcctccttggcaatataaagagcaagcactgaggccccgcctcagagcaccccaaacttgacgccatgaagatcccggtccttcctgccgtggtgctcctctccctcctggtgctccactctgcccagggagccaccctgggtggtcctgaggaagaaagcaccattgagaattatgcgtcacgacccgaggcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaaca

SEQ ID NO: 1486 - DNA, 582 bp, Homo sapiens
gcagaacggcgagtagcggagcgggacccgctgtgagtgtggcggccgcgctgggttcctagctggggaaacgtgatccaggcgaagcgccccaggaaggattggggatgctcaccccatttagagaaagaaatccacctccccaaccccaatcaagaacctgctattgtatatcatcatagagccagattacctagggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagt

SEQ ID NO: 1487 - DNA, 1870 bp, Homo sapiens; identical to SEQ ID NO: 1482

SEQ ID NO: 1488 - DNA, 2573 bp, Homo sapiens
tctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggtgggtgggggagcagggcgttctgtcgataaacgagctcccttctttgcacacatagccagttaatcggccattctgagatagtttggatggggagggggagcttctgagaatcgccagtgacagttaagtggcctattgttgacgtcctctgctgaacgacttggttggattcagcttctgccttacccccaccccctgtggattttctgttagattcatcatttgccattcaggcatcatctttcactttctccttccaacatgactgctttgtgtgctggcccctgctttactcctgctattcccaaactataaagggaactgtgtggggcttcagcaggactgagaaattgactctgctgtctgttgagaactctaataatgactgcggtgaccttcatgtctagcagaaaacccactgtctgtgctagcacaatgatgaccacctgaagacagagaaaagggaatcttgattgaattccttctcatacaatatatagttatttcctttgttctcctctccattctcttctcttccccttctccccatcgccactggaggactgatctcaaatgcagctgtgactaaaagttaatgccttttgaataataatacattgcattttgcaggctttaccaagccaattcactcaagttgtctcatctataccccttcaaaccctgtgagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggc

SEQ ID NO: 1489 - DNA, 914 bp, Homo sapiens
tctcagcactttgggaggccaaggcaggaggggcgcttgagcccaggaattcaagaccagcctgggaccgggtcccttttaggtgagactagatgaaaagggctcttcagcagctgacttcacagcaactaatttctgacaggtcagagttggcattgctcaaatctgggcttcatttccaagaagtttcacaagtctgccaggggaagtccctggacttcttgcttctttcgtgtaggacaggctgtcgaaacctcagtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaa

SEQ ID NO: 1490 - DNA, 186 bp, Homo sapiens
ccctactggtccttctgccttagccacaggttctgaaaccaaagcaaaaccaccagagagtgattcattcccgtggagtctccatctgagccctttcctagtccaggcatcccgatgttggtggatggcccatctgagcggccagccctgtgcttcttgctgttggctgtggcaatgtctttcttc

SEQ ID NO: 1491 - DNA, 1874 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgggtctcactctgtcactcaggctggagtatagtggcatgatcacagctcactgcagcctcgacctcctaggctcagttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataagggtggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaagcattttgttttgcaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaacta

SEQ ID NO: 1492 - DNA, 1773 bp, Homo sapiens
aaagtctccagaatgaggaaatgttggaagcaaataatatattcagctgagcattcttcctggcagtgggagcaggagcctgatttggaccttaaaagcttagtggcaacaacaaataagcattggcctggaaaatccacatcccaacaggctaaacaaggcaggtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatgtggtggaggctcagtttgatagccgggttcgtgcaacaggacacagttatgagaagtacaacaagtgggaaacgatagaggcttggactcaacaagtcgccactgagaatccagccctcatctctcgcagtgttatcggaaccacatttgagggacgcgctatttacctcctgaaggttggcaaagctggacaaaataagcctgccattttcatggactgtggtttccatgccagagagtggatttctcctgcattctgccagtggtttgtaagagaggctgttcgtacctatggacgtgagatccaagtgacagagcttctcgacaagttagacttttatgtcctgcctgtgctcaatattgatggctacatctacacctggaccaagagccgattttggagaaagactcgctccacccatactggatctagctgcattggcacagaccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaa

SEQ ID NO: 1493 - DNA, 4609 bp, Homo sapiens
atctgctcccgagtccccagccccgtgctgataggtgcagcccctggagtcgtggctgtgggcataggtgccagggaggggaggcccgggtcgaaggcataggcagaattggagccctgggttgccaaagcgtcgcagctaagaagccggagcccaggctagtaccggcggggcggggcggggcggggccgggagcgagcatctccatcctcagtttcctccacttgcggcaacgccacagctcggtacagttcggacctccacgccgcagcgaaagacttctgtcctccaggcaccttcactaacccggtgcggagcacttggcgacgcctccctgcccatctcatatctctcggctcatcgctgctctgggcaccagctgcctcttggctggcgctgctgtcacacggtggactgttctggccttactgagctgccgtttggggacatcagattcagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacgatattataaagctgtggaagttttttccactagtttcaggtgtttttttttttgttgttgttgttgttattttgaactacttaccaaaattagaagttaaaatctaattagaaattaataagatactaaaattcatgacagttttttgtttgtttgtttgtttgttttttggtatttcttgatttgggcataaaaggcacacccattctctcatgcttggaagaagctgctattcctactggctatctaagaagaatggaattattaattttatttgacttattaattttaaacgagtttaatttgggatcatttagtaagtactcttttctttttgagctgtgatagattatagtctagtttaagttgctcctaagtagacagatgaagaaactagggaggctttagagaggaagacagatgcttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtagctcaagcctgtaatcccagcactttgggaggccaggcaggaggattgcttgaggccaggagtttgagaccagcctgggcaacatagtaagacctcatctctacaaaaaataaaaaattatccaggtgtgggccgacagtcccagctactagggaggctaaggcagggtgattgattgagcccagtagtttgaggctgcagtgagttatgattgcgccactacactcccacttgggcaacagacaagagatcttatctctaaaaaatttttgttaaataataaaagaattaaggccagggatgttggctcacatctgtaatcccagcagggattatagtctcgggaggctgaggtgggcggattgcttgagcccggaaggtcaagaccagcctgggtgccatggtgaaaccccatctctac

SEQ ID NO: 1494 - DNA, 562 bp, Homo sapiens
tgcttctctctctctcttttactcttattctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttg

SEQ ID NO: 1495 - DNA, 585 bp, Homo sapiens
gcactccagcctgggcgacagagcgagactcctactcaaaaaaaaaaagacttcaaagcaaatacagaaagttacatagttgcaggaaacaacaacaacaacaacaactttgctcttttaatacaaaggactcagttgtcttaagtaatcaaagacctaataatagaaaacataaagcacagaaaattattttgataagacacaaaatctttgttttctagtcagagccctctaaaggtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacac

SEQ ID NO: 1496 - DNA, 1988 bp, Homo sapiens
tgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacggtgggtaccatgtgccagctcctggagtccacagtgatccaacctcaaggggacagccccgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagc

SEQ ID NO: 1497 - DNA, 602 bp, Homo sapiens
gcgctagctgggctcggctccgcactgctagctgcgcgccgccctggacggggcgcaccgactgcgcgcgcggctgcgggcaaacatcgggagtcctgcctcagctgccgcttctccagcagcagcttcaggcttctcccgcaggagcttcgggcttctcctggtagagacgtgggaacttttcttctcctggcgaggctgcagaggtgatgggccgctcccggggctcccgcggggaggcggcacggtcttctgagctacgataattttttggaacggcagaaatgattggttctagcaacagatgggaatttggagtcactctgaaatatatcctggaataagtgtgtttgactagaaccacatcttatgaggtccccaaggatgagagtctgtgctaagtcagtgttgctgtcgcactggctctttctagcctacgtgttaatggtgtgctgtaagctgatgtccgcctcaagccagcacctccggggacatgcaggtcaccaccaaatcaagcaagggacctgtgaggtggtcgccgtgcacaggtgctgcaataagaaccgcatagaagagcggtcacaaacggtcaagtgctcttg

SEQ ID NO: 1498 - DNA, 797 bp, Homo sapiens
gtcggaggtgaggagacgtcgccgggtgaggaagcggggggctagcggcctggcgctgcggcgaccgaccggggcgtcaggatccctggcccccggagagcgaagggcgggcgggtcccggaggcaccttcactaacccggtgcggagcacttggcgacgcctccctgcccatctcatatctctcggctcatcgctgctctgggcaccagctgcctcttggctggcgctgctgtcacacggtggactgttctggccttactgagctgccgtttggggacatcagattcagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggacca

SEQ ID NO: 1499 - DNA, 1917 bp, Homo sapiens
agacttgcaatgaagttagaatgaacaggaggagtctgcagcttttcagtgcctgggataactatagtttaaagatcattgtgtaaaataggatttttagtcagcatgcattgttttaaaccgactaactgatagcctaaaactttatttttgcattttgccaatccttggagttttgttttgcagaattaagaaaaaaatgaatgtatgatcatctgaaaagggctttctctcaatcccacttcatggcatgacctctgctggatcattagttctagccagagaagtagcaaaggaacatgacgtctgagacctcccttccctcatcagtggggctgactgagctgggggcttgaagccggaggtaacctttcctgtcgaatgttctctttagagaatggcaatggtctctgcgatgtcctgggtcctgtatttgtggataagtgcttgtgcaatgctactctgccatggatcccttcagcacactttccagcagcatcacctgcacagaccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatgcctccatagtgattgggaaatggtggtgtgagatggagccttgcctagaaggagaagaatgtaagacactccctgacaattctggatggatgtgcgcaacaggcaacaaaattaagaccacgagaattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatataatattttgaaatattatctattctcttcaagaaatgaacagtaccacagtttgagacggctggtgtacccctttgagttttggatgttttgtctgttttgctttgttttgttagtcatttctttttctaacggcaaggaagatatgtgcccttttgagaattcaagatggcactgacacgggaaggccagctacaggtggactcctggaatttgaggcatcataatgatactgaatcaagaacttccttctgcttctaccagatggcccaaggaagcacatcgtcctgttttattgctttctaccctgtgcaatattagcatgcaagcttggcttacatagtcatactttatattcaattgatatataataaccgttctaacctcttccaggaaaatatttttagaactactagcttttccacttagaagaaaatgaggattcttaagggagccactccaccatgctattaagactctggcagagttatgggtaggatatggatccctacatgaataagtcctgtaaatacaatgtcttaaggctttgtatagctgtcctagactgcagaaatgtcctctgattaaatccaaagtctggcatcgttaactacatagtgctgtagcaacaagtcttatcatggcatctctttctatgtttggtttgctttttccaagagtattcaggtctcctcttgtgagataggaaggccatgaaaacaattagatttcaagatgatctatgtgaccaaatgttggacagccctattaaagtggtaaacaacttctttctaaa

SEQ ID NO: 1500 - DNA, 4080 bp, Homo sapiens
ctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccaggtaggagtctgggactactagtgaacctagacctgtggctctggccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggtgaggagcccaaggagaggcctccaggaacaggaggagctctgcttccatatgtggggaggaaagggtgggctctgccagagcagcctgtgaactaatgcccagcattcctcaaggtcagccagacaaaaaggaacttaggtcttgggcagaggaggtgtagcctggggcaaagtgatgagatgtccctcctttccttggcctgatccttgtctgccttcacttccctaggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaaggtaggcttcaaagagcctatattcctctttttcccacaccgatcaagtcaactcagtactcacgggagaaaaatagactttatttacaagtaataacatttagaaaagatccatccccggcccttaaaaaccttcccatcactccaaatcccaccccagtgcaagtctggggaaggtagggtgtgagctgctgctgaaggctgtcccccaaccccactcctgagacatagggcccatccgtcctgggaaagagcatcctctggcaggtgctcccaccaggtcagacccagtcctggacttcaagagtgagggcccctgctgggcccagccaccaggacagcaggaaccagggcctactcctcttatggtcccttctagatccagaggctaagaggaagactggccaggcccaaggacccagccatcaaaaccagcctcaaatctggttgtgatggagaagtgactttgctttaagaaaaaaggaggcaaggtagggagagcgcccacactgtccatgctccaggccccctgggccagctccgagaaggcgccagtgaaggaccagggaccaggccagggtgcgggcaggcatcactgtctctaggggtttggctactgttggcctgggagctgagagaaggcactgagagggacagtaggcggaggaccaggtgaggtcagcatcggggacacaggtggggccactcactggtactggccctttagtgctttgcctgaaagagacacagtcacatggccagatgagaacttgcgatactagcctgcacccactggctgggaagatctcttcctgctcccacgcccctgtctggatcccctcccttgtgagccccagggttatcagttgctggctgtgcctgagcagctctgggtgctctccatgagaatggggccatctgtcttctctccttggagaggagctaccagg

SEQ ID NO: 1501 - DNA, 2650 bp, Homo sapiens
gttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatga

SEQ ID NO: 1502 - DNA, 552 bp, Homo sapiens
aactgcttctctctctctcttttactcttattctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgagcctctaggtgctgtgctgtcctgaggcctgggccatggtgcccaaggaaagcccctgaagctcaccaggaggaagaagcatgcagggcacccctggaggcggga

SEQ ID NO: 1503 - DNA, 589 bp, Homo sapiens
tgtatgtgagcacacccacattttcactgccattatctgggacagcagaaccaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaa

SEQ ID NO: 1504 - DNA, 449 bp, Homo sapiens
ccagagcactcacgggctgccagggtgagcaggctagaaactcacgacaccagatttcctgctcagcatggacaggacagcaagaggctaaccctctgcccaggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcagcctcgcccaccaaggagatccaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacat

SEQ ID NO: 1505 - DNA, 3007 bp, Homo sapiens
gaggcacattgtccacgtcaagaccaagagctgcatccactagtttgcaccctggaaacaagggtcaatcaaaatgaagcttctcctttgggcctgcattgtatgtgttgcttttgcaaggaagagacggttccccttcattggtgaggatgacaatgacgatggtcacccacttcatccatctctgaatattccttatggcatacggaatttaccacctcctctttattatcgcccagtgaatacagtccccagttaccctgggaatacttacactgacacagggttaccttcgtatccctggattctaacttctcctggattcccctatgtctatcacatccgtggttttcccttagctactcagttgaatgttcctcctctccctcctaggggtttcccgtttgtccctccttcaaggtttttttcagcagctgcagcacccgctgccccacctattgcagctgagcctgctgcagctgcacctcttacagccacacctgtagcagctgagcctgctgcaggggcccctgttgcagctgagcctgctgcagaggcacctgttggagctgagcctgctgcagaggcacctgttgcagctgagcctgctgcagaggcacctgttggagtggagccagctgcagaggaaccttcaccagctgagcctgctacagccaagcctgctgccccagaacctcacccttctccctctcttgaacaggcaaatcagtgaaattctctagaagagtaccatgggttcatttctatactgatgcagaaataagtgaaatctacaaaagttttctttcttttccaaagactatttcattctgttgtattcagagtattcatctcactacattgatttgtttgtggtagtttttccttggacttaatttatattgaaaaaacattgataattaaataaataaaatagataatttagaccaatggtgataaggtctggatgaaaactacgctatggaggactgaaatggcaatcattcagcctagcctggagtctgattatacagctactataggatgatgttagtattggttttgagtgcaataggttttttcctaaacaaacatattttgtagtcaatgaactttttgtcacaaaacagtaaaacatctgtgtttaacctatggtaaacaacatgttaatgaactatgctatccatgacttaatggacagttcaaatgtgacatctacagtttttcatttctcttttatgccagcacacaatcaattcatcaccaattgtcatttgatttacttcaaaaaatatacccccaaatcctaatacttctaaccttctccactgcatctagccaactctagctattgtcatccctaacagaaatggaggaatagcctctttttttttttttttttttgagacgaagtctcacactgttgcacggctgtagtgcaatggtgccaactcagctcactgcaacttccacctcccgggttcaagtgattctcctgcctcagcctcctgagtagccgggattacaggtgtgtgccaccacgcctggctaattttttgtaatttagtacagacaggggttccctatgttggccaggatggtcttgatctcctgacctcatgatctgtccgcctcggcctcccaaagtgctgggaatacaggcgtgagccaccgtgccctgccagaatagcctattaaccagtctacctgcttccacttttcctccaccctgatcacatacacacatgcattatccactgagcagtcacaatcagatgttaaaccaaacattattcagataagatctctgaaaagcctctgatactttctcttttaaaatggaatatattctaaacacctctccaaggacacaagacttaccttgtctaactaatgacttttctaacttcattccctatcattctccatcttgccccatgctcctcatgcagcagcttttttttttttttcctttttcaaatatgttggttttgatcttatccaagaacctttgccctgatgtatgaatgactaactgcttttctacttcgggggtctcatatagaaatcctgcttcagaatactcttccctgagcactctatctaaataaatccctcttctgcaacccagtgctttttgttctattactgacttcttttccttgtagaagttactattactgctttttacctttttatttatttgtgtattgtctttgttgttgccctcatcttatctccacaaaaatatatgctccataaaaacaggcatttctgtgtcttattcagcactttatcagggcctataacaatgcctgggacatattcagtgaccagtgaatatttttggaaggaaagaaaagaagaaagaatgaagtaacaaacaaagaatgaaggaagaaaaaatttttacaaacattcaacatatttttattttgaaataattttgtatttttccctatatcctacattggatcagaatattactgttatgtatagccatgaggacatggtctcaaaaaatgagaaactttcttagacagtaaaattgttaacttgagatgtttgcttccatcttctagagccaagtaggatctaactttaatttgacttagccaataatctgaaactattatagtatctgtctttcacagatacatgcaatattcacttctaaatatttaatgataaatttgtaatcatacatgatagtcaattttaatgattatgttgtcaaaattcaggctttttgtgtgaattgaagacttaaagaagaatttgtaaatatgactgtataagaaacaacagaaagatgaagatgaaccgaaatagaaatatcaagaggctacaaagtcttagcaaattataattgctaatggtacattatgtggtgtttagtatcacatttagaatgtagtcatttgttaagtttttcatggggtaaaagaaagaatttattccaagaaaattttggaattttaaaaataaacatgacatcttatcatga

SEQ ID NO: 1506 - DNA, 1943 bp, Homo sapiens
agccctgctgatggggaagtccgaaggcccagtggggatggtggagagcgccggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagctgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggt

SEQ ID NO: 1507 - DNA, 574 bp, Homo sapiens
acttttcaaatgctactaaggaaagttagacatggaacttaatagttttcacaggtattcacgagtcctcaggagtccagagacctcagtttgagaacactatcctagcactgaccttgacttccagggtgaccttgagccaggctgctcagtccctctctgcgggggcctagaggctcggtgaggggagcgggacttggttgccatggtcacattgaagccagccgcagctggcccgggcagctgctcctcctgggcccggggccccggacgctcggacaaagccaggcagcgttggcagccccagacccgaccccaaaggcctgagactggggtgactgggacctaagagaatcctgagctggagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagat

SEQ ID NO: 1508 - DNA, 527 bp, Homo sapiens
ggacaaagccaggcagcgttggcagccccagacccgaccccaaaggcctgagactggggtgactgggacctaagagaatcctgagctggagagctacgtcatctcaatctcctccttcgctccctggcctcagtttccagtttattcagtggcatcaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagct

SEQ ID NO: 1509 - DNA, 2520 bp, Homo sapiens
aacttcaatttttctgcagtggctctgggtccagccccttacttaaagatctggaaagcatgaagactgggctttttttcctatgtctcttgggaactgcagctgcaatcccggtgaaaaggagataagaagcaaaggagcaaaccaaacctaatatgaatcctgtactttggccagaagccgtggctcacatctgtaatcccagcactttgggaggccaagacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaaga

SEQ ID NO: 1510 - DNA, 636 bp, Homo sapiens
agaaactctgtgagggttgtcagggacactgagaggtgggtgtgtgcatgccacatttagcctcgctgtttacagccagttcaagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctg

SEQ ID NO: 1511 - DNA, 455 bp, Homo sapiens
atgctgccttgcctcgccctgcttctcctgatggagctgtccgtgtgcactgtggcaggtgatggtggagaggaacagacactcagcactgaagcagagacctgggtaattgtggccttggaggtacttttggggagaggctctgacgagggcaggggataatcggcagtgcagaggcagaagatcccctgcatggctgctgggagagcaggcagtctgcaaggcaagttgtctgactctctaccatgggtagattcaaggctatgagccctggcctggcagacctccgaagtgtgtgtgtgtgtgtgtgtgtgtgtgtgtgtgtctgtgtgtgtgtgtgtgtgtgtaagaaatacttatttaacacacggtatatctctggcactgtctgaaatgctttataaatattaactcaatcctcccatcaacctcatggggaagcgagtgggaggtga

SEQ ID NO: 1512 - DNA, 572 bp, Homo sapiens
agaggcagccaccttctggaagtgggaactggggggactggatgtctgggtctcaggaaggcagagcagggataactgggcccaagatgccctgaacctgataagaggtggcagtcgagtccctcaggactccagggcctggagacttcagtacagggctctgagaccagtacaggttaggatagcttttcctgcagcaggggaggggagagtagttacttgggtttgtaaggagatgccatttagaatagttttatgtggggtaagcttcctgggcctgaggaacagagtagggattttcaaactttaatgggcacaggtcacctgggaattgtgttaaaaggcagattttgattgagcaggtcaagggtgagcctgagattctgatttcttccatgcttccagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccat

SEQ ID NO: 1513 - DNA, 571 bp, Homo sapiens
ctcagccgttggaacgtccttgggcttctgaactagtgcccatgtgtgcctcggcctttcccaagggccagcttcttcctggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctgg

SEQ ID NO: 1514 - DNA, 460 bp, Homo sapiens
gtgtttgctctgtctcagaaactctgtgagggttgtcagggacactgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttact

SEQ ID NO: 1515 - DNA, 542 bp, Homo sapiens
gagcgggactgcagccagccccctggggcgccagctttggaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttg

SEQ ID NO: 1516 - DNA, 1156 bp, Homo sapiens
tatatccaaggtgcagcagctgagcattccaaattcgggaaccaccagaaaggctggcctctcttcaacatgggatcttctggacttttgagcctcctggtgctattcgtcctcttagcgaatgtccagggacctggtctgactgattggttatttcccaggagatgtcccaaaatcagagaagaatgtgaattccaagaaagggatgtgtgtacaaaggacagacaatgccaggacaacaagaagtgttgtgtcttcagctgcggaaaaaaatgtttagatctcaaacaagatgtatgcgaaatgccaaaagaaactggcccctgcctggcttattttcttcattggtggtatgacaagaaagataatacttgctccatgtttgtctatggtggctgccagggaaacaataacaacttccaatccaaagccaactgcctgaacacctgcaagaataaacagccgtgtcccaaaatcaaagtggaatgcgaagtggaagaaatagaccagtgtaccaaacccagagattgcccagaaaacatgaagtgttgcccgttcagccgtggaaagaaatgtttagacttcagaaaggcctctctgtctacataaatccaggatgccttccctgaccaccttagaccgcctacactctttcttctctgcccatattattgagctctaaagaagatcatcaaggaccattcgttcattctattcattcaacaaatattgattggtgcccctgacacccatgatgggttccacttgctcattgtggccaggaaggtcagaaaagtttttctgggaaagagatccatgatttaagatctgaaagatgagtacttagaccaaaaatgggaagaaatagcctttcaggccagataataggatgtgcaaaggctctgtggcaggaggcaggatgttcaggtctagaaaggctagaaagcagagagtgagcaagagacaagaaacaggaaactggtagtgtatattcagggcaacttgaatctgtattcccaagtggccatcctcaagttttggggtcaaataaatgccctacttaatgatattttctgaatcttgttactttaggttgacatacctttcaagacaataactaggttttcagtgctttgataaaacctcaaatgtgtgg

SEQ ID NO: 1517 - DNA, 568 bp, Homo sapiens
cagttgcttatagtctaggaagggatcacttgtgtaacatgggagcaaatgctgcctagcggaatattcgtgacttgggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaag

SEQ ID NO: 1518 - DNA, 556 bp, Homo sapiens
agttagacatggaacttaatagttttcacaggtattcacgagtcctcaggagtccagagacctcagtttgagaacactatcctagcactgaccttgacttccagggtgaccttgagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaa

SEQ ID NO: 1519 - DNA, 673 bp, Homo sapiens
acattgaagccagccgcagctggcccgggcagctgctcctcctgggcccggggccccggacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtggg

SEQ ID NO: 1520 - DNA, 2970 bp, Homo sapiens
agaataattgggaggagtctggcaggaaggaagccaagtttcctgaggccctcaccagaagctcatcagaagcagatgctggcaccactcttcttatgctgtctgcgtaacttgttcagaaaactcattagcttccaacctcctcaattaggcagaacaaacatgcattactccaaattgccccgcactgcgatagagacagagttcaagcagaatgttggcccaccacccaaggatctgaccgctgaagtttacttcccttcaatcaaatcgagatcacatcttcctgcagttttctataatcagtatttcaagcatccaaaatgtgtaggagaatatggacccaagaacggagcagagagacaaatagaggaacggaaagttttgcctacaaccatgatgttctcaatgttagctgactgtgttctaaaatccactccaattcccattttgggagttgctatgtgatgaaggtctgcccctgtggtgttgggacaacttgctcatggagttgcagttcttgcctaacaggaacccaccatggtaagaaaaagactcaagctggtttatttgtttttaaggttgcaaggtaatcaagtccataaccacacttgctctcacatttaccaaaataggccaatctcagaactaaatgataaaaatgaaaattaatcagggactcccatgggcctcacatatatggcagttttgaatctgttctttttttcactatcataattgtttttttaaactcattttctctgcttgaatacacaactgtaaaaaaaagtgggggtagtggtggtgatagaaatgaataaacccatggaaacagtgagacatctacagagacaaaattaggaaggaaggaaacaaaagcaatttcagtatctctgtgcaaggcctgcatacctttccttgccaatacccgtggattgggcttgtctcaggaggtagcaggtgtttccttgactcacacagaaaacaagcccttgggcttcttgtgctgttagggcaagttacgttcagcacatgaacactggaccctgctttgcctgtccgtccttcccagaagagacacagatcacagatgatcaagtagttgagaaaacagttcaagaggaggctttgtatcttttctttcttttctttccttttttttttttttttgaaacggagtctcgctctgttgcccaggctggagtgcagtggcattatctcggctcactgcagcctttgcctcccgggttcaagtgattctcctgcctcagcctcctgagtagctgggtttacaggtgcctgccagcacgcccagctaatttttgtatttttagtagagacggggtttcactgtgttagccaggatggtctcgatctcctgacctcatgatccacccgcttcagcctcccaaagtgctgggattacaggcataagccacagcacccggccctgtgtcttttcttaatttgagcgaacttaaagtaaaaacgcttcttaacattataaagtaggactatgtcccctccattgaatttttgtaaaaaagtcgaatagggatagaaagcaagcaaccagatagaatatcatgccccagaacatcatttaccttggtagaacattaccactttaacacatagaaaccttttcacactagttaacaaatagcattaagcatgattcaagtcaagattttaaaaacttggctgatgcctctcattaagagttgaaaactatataagactcttgctccaggaaactgtgttctgacattttaatagtattgcgttagcaagagcagaaaatccatgaacttagattcacagaaagtaaatcaagaatccatccaaaatggagtgcctcttgctgagtgatgggatggttttcatgtgagatgtcagtgcagcttctatacttgacataaaagttcccattaaaaaaaacggaactgctgctcaatttttttttcatcaagcagagttacctaaagtgctttttagaagagactattaggaaaggaatggaaagtagtcattatgactaatctgctttaggagttggggtaaccagtattacaggagggactttcagagccatggggaccttttaggcaactcaaattccttcaattgtttgcagtggtcctctcgaggggatgtaatgagttgacatgcaccagaacagatagaatgcactgccagctggtagtttactcttgtacaggaaggctgcttttctaacacacaactctttgttgtgttaaagagaaataaatatataaaagcctaaaagtaagctttcaattctttatgtctggcaaaattgtcagtacaatgtgccttgaggatatatccatggtgctgtcttacaaggttattacgaaagaataagctcatactataataaccaccccatacactttacagtttatgaagaacttacatatacattttctcagttgaacctcacaacatcagtgggaggcaggggaggcagatattattatctcttgagagggagtgaccctgctgctgctgctgtatatgtgtggcttttggtttaggaagactaagttgattgtgttgtattttcaagtattttatatcgtacaaggatgtttattgcagcactgtttataacaaggaaaaattggaacctactcgaatgcttgctaataggggactcattaaactatggtacaagcttagatatgactctgtagtcattaagaattttgatgaggtattagaaagaaatgtattgatgttgaagtatatttattgatgaaggaaattgttcacaatatttcagccaataaacaatagtatatgcatttttttgtaataggaaaaaatgcacacagtaaaatagtggttatctttgtgtgcggtgaatatgtatgatacttgttttctttttcatgctcacctatcaattctaatcttagtgtcaataaatattaaaaatgtact

SEQ ID NO: 1521 - DNA, 453 bp, Homo sapiens
ctcttcgctcatcgccctgcgcgccctgccccgcagatgccggcgatcgcggtgttggcggcggccgccgcggcgtggtgcttcctccaagtcgagagccggcacctggacgcgctcgccggaggcgcgggccccaaccacggcaatttcctagacaatgaccagtggctgagcaccgtctcccagtacgaccgggacaagtactggaaccgctttcgagacgatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgt

SEQ ID NO: 1522 - DNA, 871 bp, Homo sapiens
atgaggcttctcattctcacctgtcttgtggctgttgctcttgccaggcctaaacttcctcttagatacccagaacgccttcagaatccatcagagagcagtgagcctataccattagaatcaagagaggaatacatgaatggtatgaacaggcagagaaacattctgagagaaaaacagactgatgaaatcaagaactgtgttgtggcagagcctgagaagatggaatccagcatcagttcatcgagtgaggaacagttttgtagactgaacgaatacaaccaacttcagctgcaagctgcccatgcccaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagttttctagtggacattttgtttaaaaagtctttgaattgccagttctgtaagtgccatcaattaaaatagttttgtgcagtgacagagattttcttttttcttttcaataaat

SEQ ID NO: 1523 - DNA, 1387 bp, Homo sapiens
gcaactcgaacttggtcggggcgcggatcccgagagggaaagtcataacaaccgcacgagggagttcgactggcgaactggaaggccacgcctcctcccgcctgccccctcagccctgtggctgggggcagagctcagatttattatctaggatagatttggatgaactaatgaaaaaagatgaaccgcctcttgattttcctgataccctggaaggatttgaatatgcttttaatgaaaagggacagttaagacacataaaaactggggaaccatttgtttttaactaccgggaagatttacacagatggaaccagaaaagatacgaggctctaggagagatcatcacgaagtatgtatatgagctcctggaaaaggattgtaatttgaaaaaagtatctattccagaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagaaaatggttctcctgaagaacatgcaatctatgtttgggatcatttcatagctcaggctgctgctgagaatgtgtttttcgttgctcacagctatggaggacttgcttttgttgaactgatgattcaacgagaagccgatgtaaaaaataaggtaactgctgtggcattgacagactctgttcacaatgtgtggcatcaagaagctggcaaaacgattcgagaatggatgagagagaactgttgtaattgggtctctagctcagaaccattagacacatcagtggagtccatgctacctgattgcccccgggtctcagcaggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcactgcttgtgtcgagcggactcccagcccctcattagattgttttcttcccagagcccagggtcgtgatatatacatctaaatagcgttttgcattatttctagatgagtgcaactgtcaaagcaatatgggttcactggtcgtgcttcctgcgggctgagcgcgggctgagcgctgccagtcagcgctcacattaaggctgacagcgccctgcctggctcggccggcgaagctctaatt

SEQ ID NO: 1524 - DNA, 7719 bp, Homo sapiens
ggcagctgtgctggctgccgctgctggcaccgctcctgttgctgcgaccgccaggggtccagtccgccggccccatccgggccttcgtggtgccccacagccacatggacgtgggctgggtctacactgtgcaggaaagcatgcgggcgtacgccgccaatgtctacacctcagtggtggaagagctggcccgcggccagcagcgccggttcatcgctgtggagcaggagtttttccggctgtggtgggatggcgtcgcctcggaccagcagaaataccaggtccgccagctcctggaggaaggacgcctggaatttgtcatcggaggccaggtcatgcatgacgaggctgtgacgcaccttgatgaccagatcctgcagctcacagaaggacacgggtttctctatgaaacatttgggatccggccacagttctcctggcacgttgacccgtttggcgcctctgccacgacgcccaccctatttgcgctggcgggcttcaatgcccacctcggctcccggatcgactacgacctgaaggcagccatgcaggaggcccgggggctgcagttcgtgtggcgagggtccccatccctctcagagcggcaggaaatcttcacgcacatcatggaccagtacagctactgcaccccgtcccacatccctttctccaacaggtcaggattttactggaatggcgtggctgtcttccccaagcctccccaagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctatatgaagtgggcgaggacccagtcctgtctcagccagtgacagtgaatctggaggtgaacttccccacccccatccagaccataagccagggaagcaaaccctagatgaagccccaagaaactgccttggcaaagagatccacgagggcttcctcccaaatggacgctggtatgggccccaccccgcccttcttcatggtcttctgggtttgtcaggtattacaactggcctggttttttagggttttttgtgtatatgtgagacaggatctcactctgttgcccagtctggggtgcagtggcacaatctcagctcactgcaacctctgcctccctggctcaagtgatcctcccacctcaacctcccaagtaactgggatcacaggggcgcgccaccacgatggctaagtttttttttttttttttgagaccgagtttcgctctcgtcccccaggctggagtgcaatggtgcgctctcagctggctgcaacctccatctcccaggttcaagtgattctcctgcctcagcctcccgagtagctgggattacaggcatgtgccaccacgcccggctaatttttttgtacttttagtagagacagggtttctccatgttggtcaggctggtcacgaacccctgacttcaggtgatccacctgcctcggcctcgcaaagtgctgggattacaggcgtgagccaccaagcctggcctagtttttttatttttagtagagacacggtcttgctgtgttgctcaggctggtctcgaacgtctggcctcaagcaatctgcctgtcttagcctcctgaagtgctgggattacaggcgtgagtggcctgtattttctttcttatttattctgtggtaaaacttttaaaacacagacaacatctgtgtaatccaaaaacaaaacagattccccatagagttgctttgaaaggtgacttagagtcagacaatccagggtccacacccaggcccctctacgggggcatctccggcaccccatgcctctgggcctcagtttccccccatgtaaaatggggagaggtgagagttctttgcccagaaggttgctgagaggccctggcactaaggggcctcgtgcagtgtcagggcccccaggcctcgtccccttccaggttcccctcttggctgatgttgccctctcagctctactatcaggcgaggcttccgccacctggcctgcccacgctccctccccagaaggcatgacctgagccgcctcatttctttcccagtttgcattctttctatttcatttcctgctcatggagaatttctgtgaatctctgtgtttctgccttgggcctccttcgacatctgagtcttcaggggaatccagagaagccccagtaccttttcgccatgatgtcttactgggccacccacctcctctttcatgatcctcgccacggaggatcctttcctcacggtccctggcctgcctgagagcaggtctaggccatggcgggtaccagtgcccagcacagggccagcctgccctgggaagcaaggaggccagcgtgggacctggaagttggtcatctgatgctcccccgtttcacagatggaagcaccaaggccctgagacaaggagacggttgggatggacaccatgactccctgcccaacgtggacggtggtggggtggaaagaccattgagttaggaacgcagtgagtttggctgcaagtcacaaaacacctaacagatgtgcttagaacagaggacagagtgttttctcaccgaacaggcatgtccgatggaccccaagcgctgtcaccgtgggcccgatcactgtcatcttcccgccatcgccggcagactggcttttgtcttttgccgtctgcttgtttgcggtcacaagatggcacaggcctccctcatgagcaaatttcaaggcagggtagggctcagcagtagtggccagaaaggccttgccctagcgtggctctctccctccgtcagcacacagaagcttctccaagagccacccccagccctcctgctccacagacttttccagacccctaagggcctcctgcctcccctaggtgtaagggaggctgggacaaggcctattgggaaagggggatggggtaactgtggctggcttcctccctggactgggcacggggccacctgagcaatgtggggagaggagaactccgcggtggggtgggcagctcaaaatgccacacctcccgggctgctcctccagctcggccacctggtaaagcatgcacctcccgcttcagtgtcctcatctgtaaagtacacggccagtcctgtcctcgcagatgtgctgtgagaagcagatgagggagctgtgtcaggcaccaggggaggacctgggctcctgaggacaccgagttcgtggtgtgtctgccctgctgctgtcttggttctctgctcagctctggaacttggtgcagctcactctccctctgctcctctccctgcaggctgtgctgcaggcgctggggtccgtggtggcagtggaggagcgctcgctcacagggacctgggatttgagcatgctgcaccgctggagctggaggacggggcctggccgccacagaggtttggggacccccgcttcagctccctacccaggactcccagccaggctcagcagctggtcagacccggtgcacatccaaccatctgcctgtcccggcctgtgcgaccttgcgaggctgctttcctactctgaacccgcagccctcccaaatctactacagtcggttaagaaaggctttgggttagtctctgcctgccagggctccacacaggcgtgtgtgtgcacttgtacgtgtgcacacgcagaccacacgccctgcctgtgccctgggtgacagctaggggcccaggggcttctgcccaccttggccctgctgacctcagcccatcagccggtccctgcctcatacgacatgtgccaccgtgagctcctgcactacaggcagcttccaggctccactccctgtccgcaccatgccctctgcctgggacgcacaggtcccattcactctggccagcacctgctcaagctccccaggatgcctccccagagtcaccaaccaggccaagtgcctcctccactctcctggccccaggggtttcttctgtcctgtgcagctcgttgtccactacacacagcatggtggcgggtgcatggtgcacgctcagttggtggtgggaggaaggaagggacggagggagggagggagggaagatgatgttggttggaaagaaggaaggaagatggatgagtgatagataagtggacggctccctcccaagatcgaagcccaaccccagggcatgccttcaggggagcctggtgaggcaagggcagactcaccagatggtctcagaaagctcttgggctttgagggcaacacccatgaggaattgaggccactagggccaggaccaacctatgaattgccctcagggtgggcagaaacgccaagaggcccacaggagtcctggcagaaggggatgccataggccgttgccacggtgggagccacagcagactgtagccaggtgcagtgtggtgagaaggaggctgggagccacagcagattgtagacaggtgcaggagggtgagagggaggctgggagccacagcagactgtagacaggtgcagggggtgagagggaggctgggaggaggcatcccaggccacactggacagatcacctctgttcccctaggtgacaccacctctccctcgaggccaccaggaggccccatcatcaccgtccacccaaaggaaatccggacgttctttattcactttcaacagcagtgagccctgggcagatgccccggccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagagcacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggaagttgtagcgcctagcgagagttccagccccagacgcccacctgtgcctcagggcaccgcctgccgagcagagaaggcacagcagccgtcagagtccatgagaggtgaaaccacacagcagggatgtccaatatcagaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatg

SEQ ID NO: 1525 - DNA, 889 bp, Homo sapiens
agagaaacaaggctggcttcaagtgatctgcaaccagagtaattgggatttgacaaggactgtgaaaggctgactctccctgttctctttcatgctggcaccgggcagagtgtgggaactactgcctcaatacgatcatagaagccattgagatcccgcagtttatcggccgcagttacctgacgtatgacaacccagatatcttgaagaggtaataagcttcaacaggcaccttcctcagctttctggggggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaac

SEQ ID NO: 1526 - DNA, 2187 bp, Homo sapiens
gcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagacgagcacatcccagctcctcttgaccaaggcagtgaacagcctcttttccaacccctggatcaccaagccacaagtttgccttcaagggatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcagtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagc

SEQ ID NO: 1527 - DNA, 573 bp, Homo sapiens
agattccccagctgctgttctctggaggggttcctggggcggagatgtgcagtggagcgagaacttcctgtgaccgtgacattgtctaggtggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggat

SEQ ID NO: 1528 - DNA, 562 bp, Homo sapiens
agtccagcgtctcctgggcctagattccccagctgctgttctctggaggggttcctggggcggagatgtgcagtggagcgagaacttcctgtgaccgtgacattgtctaggtggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcg

SEQ ID NO: 1529 - DNA, 552 bp, Homo sapiens
atctgcaaccagagtaattgggatttgacaaggactgtgaaaggctgactctccctgttctctttcatgctggcaccgggcagagtgtgggaactactgcctcaatagtaagtacaaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacag

SEQ ID NO: 1530 - DNA, 3073 bp, Homo sapiens
cccctctcactcagtgcggaggaactgagccccgggaggaggtgctcctgtgcagccccactgagtcagctcatctatcgcctgccctccacctggccagtccctgcgggcatctaactgctaagcctccgctcagccaacacccagttggtcagtctggtcacagtccagcaaaaagagggactgccactctaacccaccagtgacaccactcttcccggctggatggtcaattagctctggcatgagagaatgtcactgccgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgca

SEQ ID NO: 1531 - DNA, 538 bp, Homo sapiens
acccgaccccaaaggcctgagactggggtgactgggacctaagagaatcctgagctggaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcg

SEQ ID NO: 1532 - DNA, 1369 bp, Homo sapiens
gtatcaatctcctgaagaccccggaagtgcaactcgaacttggtcggggcgcggatcccgagagggaaagtcataacaaccgcacgagggagttcgactggcgaactggaaggccacgcctcctcccgcctgccccctcagccctgtggctgggggcagagctcagatttattatctaggatagatttggatgaactaatgaaaaaagatgaaccgcctcttgattttcctgataccctggaaggatttgaatatgcttttaatgaaaagggacagttaagacacataaaaactggggaaccatttgtttttaactaccgggaagatttacacagatggaaccagaaaagatacgaggctctaggagagatcatcacgaagtatgtatatgagctcctggaaaaggattgtaatttgaaaaaagtatctattccagtagatgccactgagagtgaaccaaagagttttatctttatgagtgaggatgctttgacaaatccacagaaactgatggttttaattcatggtagtggtgttgtcagggcagggcagtgggctagaagacttattataaatgaagatctggacagtggcacacagataccgtttattaaaagagctgtggctgaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagaaaatggttctcctgaagaacatgcaatctatgtttgggatcatttcatagctcaggctgctgctgagaatgtgtttttcgttgctcacagctatggaggacttgcttttgttgaactgatgattcaacgagaagccgatgtaaaaaataaggtaactgctgtggcattgacagactctgttcacaatgtgtggcatcaagaagctggcaaaacgattcgagaatggatgagagagaactgttgtaattgggtctctagctcagaaccattagacacatcagtggagtccatgctacctgattgcccccgggtctcagcaggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcac

SEQ ID NO: 1533 - DNA, 583 bp, Homo sapiens
attgtctgaggcaaaaagacatcaagtcctttcatgctgtcctgggaaaggcggtttggaacaagttatcctgattctagagacaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctgg

SEQ ID NO: 1534 - DNA, 1524 bp, Homo sapiens
cttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaacatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctg

SEQ ID NO: 1535 - DNA, 4784 bp, Homo sapiens
cttcctagacagactaaaaaagccatgtattctttcgtttctctctaaaagaagaaaaatataatttaaaaatacattgcgtattttctaaaacaataaatttatagtgttaatattcatagggtcaatcaaaatgaagcttctcctttgggcctgcattgtatgtgttgcttttgcaaggaagaatgctggattgggcttcctatggctgtgaagtgccattgctggagagacggttccccttcattggtgaggatgacaatgacgatggtcacccacttcatccatctctgaatattccttatggcatacggaatttaccacctcctctttattatcgcccagtgaatacagtccccagttaccctgggaatacttacactgacacagggttaccttcgtatccctggattctaacttctcctggattcccctatgtctatcacatccgtggttttcccttagctactcagttgaatgttcctcctctccctcctaggggtttcccgtttgtccctccttcaaggtttttttcagcagctgcagcacccgctgccccacctattgcagctgagcctgctgcagctgcacctcttacagccacacctgtagcagctgagcctgctgcaggggcccctgttgcagctgagcctgctgcagaggcacctgttggagctgagcctgctgcagaggcacctgttgcagctgagcctgctgcagaggcacctgttggagtggagccagctgcagaggaaccttcaccagctgagcctgctacagccaagcctgctgccccagaacctcacccttctccctctcttgaacaggcaaatcagtgaaattctctagaagagtaccatgggttcatttctatactgatgcagaaataagtgaaatctacaaaagttttctttcttttccaaagactatttcattctgttgtattcagagtattcatctcactacattgatttgtttgtggtagtttttccttggacttaatttatattgaaaaaacattgataattaaataaataaaatagataatttagaccaatggtgataaggtctggatgaaaactacgctatggaggactgaaatggcaatcattcagcctagcctggagtctgattatacagctactataggatgatgttagtattggttttgagtgcaataggttttttcctaaacaaacatattttgtagtcaatgaactttttgtcacaaaacagtaaaacatctgtgtttaacctatggtaaacaacatgttaatgaactatgctatccatgacttaatggacagttcaaatgtgacatctacagtttttcatttctcttttatgccagcacacaatcaattcatcaccaattgtcatttgatttacttcaaaaaatatacccccaaatcctaatacttctaaccttctccactgcatctagccaactctagctattgtcatccctaacagaaatggaggaatagcctctttttttttttttttttttgagacgaagtctcacactgttgcacggctgtagtgcaatggtgccaactcagctcactgcaacttccacctcccgggttcaagtgattctcctgcctcagcctcctgagtagccgggattacaggtgtgtgccaccacgcctggctaattttttgtaatttagtacagacaggggttccctatgttggccaggatggtcttgatctcctgacctcatgatctgtccgcctcggcctcccaaagtgctgggaatacaggcgtgagccaccgtgccctgccagaatagcctattaaccagtctacctgcttccacttttcctccaccctgatcacatacacacatgcattatccactgagcagtcacaatcagatgttaaaccaaacattattcagataagatctctgaaaagcctctgatactttctcttttaaaatggaatatattctaaacacctctccaaggacacaagacttaccttgtctaactaatgacttttctaacttcattccctatcattctccatcttgccccatgctcctcatgcagcagcttttttttttttttcctttttcaaatatgttggttttgatcttatccaagaacctttgccctgatgtatgaatgactaactgcttttctacttcgggggtctcatatagaaatcctgcttcagaatactcttccctgagcactctatctaaataaatccctcttctgcaacccagtgctttttgttctattactgacttcttttccttgtagaagttactattactgctttttacctttttatttatttgtgtattgtctttgttgttgccctcatcttatctccacaaaaatatatgctccataaaaacaggcatttctgtgtcttattcagcactttatcagggcctataacaatgcctgggacatattcagtgaccagtgaatatttttggaaggaaagaaaagaagaaagaatgaagtaacaaacaaagaatgaaggaagaaaaaatttttacaaacattcaacatatttttattttgaaataattttgtatttttccctatatcctacattggatcagaatattactgttatgtatagccatgaggacatggtctcaaaaaatgagaaactttcttagacagtaaaattgttaacttgagatgtttgcttccatcttctagagccaagtaggatctaactttaatttgacttagccaataatctgaaactattatagtatctgtctttcacagatacatgcaatattcacttctaaatatttaatgataaatttgtaatcatacatgatagtcaattttaatgattatgttgtcaaaattcaggctttttgtgtgaattgaagacttaaagaagaatttgtaaatatgactgtataagaaacaacagaaagatgaagatgaaccgaaatagaaatatcaagaggctacaaagtcttagcaaattataattgctaatggtacattatgtggtgtttagtatcacatttagaatgtagtcatttgttaagtttttcatggggtaaaagaaagaatttattccaagaaaattttggaattttaaaaataaacatgacatcttatcatgagaaacatttacagtttttgcttttactacaagatactgtgaaatgttctgctctgtcagttgtgaaagtatgaaatttaagtctatcactacaataatattttgtttttagtgttcatttttttcctcctgactacattgagatgagttagattgagtgaaaggtaaacactaacatttgaattgaggtaatttccactgtggaaaacaaactgttgttagtaaacaggcatcagctttgagacacagaaaagtcatccaaaccagaagattgggaacttcctcaattactttgtcttccatttattgcattcaattagtcaaaaatgttgttaattatacattttaaagactatttttggtaaggtctatgacacattcaaaatactacatacaagtttgtattatcataaataatccaaaagaaaacatacatgtaaccaccaccatctggaaatttcacactaaattataaaacatttccatcactgcatgtattgtttaatgtcgctttatgaatccaccttcttccttatctgtagagttaaaaactacttagtggattagggtaattcattctacttttaaaaatgatttttccacctctaatgtattctataaaataatattgttcacttttgcctatttttgagctttttatagaaaaatgctactgcgaaattattttgagtcatatcttttgatcgatattaagatacatttgcagagttttgtatgtgtgtttatatccatcttacataattctttactgtatagcgttccctttagccactggaaaatgatataatgtcattgcttacagaaggtgactgattcttattcagtgctactttctacagacaggtaactattcgcatttacgattaagaaatgttcacaccttcacactggtatcaactgcaacaaccactatacttctccagtgattgccagatggcccactatacatcctttcttctatttctttcttttgtggccagaaagtcaggacctcaaagaggtataagtttgtgtgtataattccctggcttttttctaaaattttagtatgcatttatgtggcacttaatatataaaagagttttatgagttttaaaaatgtatataaacaagacatataataaatggtatgtcatttcacaatttactatttttactcaacatttatatttctgagacttttcacatttttgaatgtattcatagtttcactttaattgatgtttgccatgaaagatcaaatatatcacattttatttgactaaaaagtaaactatatttcctacattatgctatagaacttatagactaatttaagttaattataggccttatctcagacctttgcaagtagcctgaataaaacttttcattatttatattatcacatgcatatatgtgtgtatgtatatatgtgtgcatgtgcatgcatagtaaaaatcttaacccaaaactgaaataaaaaattataagagaaaatactattttccaccaatatcacaatggataatcttttttaaatgactacatatgtcgataagttacaaaatccatatatgagtatgacaccaataagaacattttctctaaccattttgaatacgaataaccatggattctaatagcaaacattattaaaatattattgaaa

SEQ ID NO: 1536 - DNA, 615 bp, Homo sapiens
acccccagtccagcgtctcctgggcctagattccccagctgctgttctctggaggggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctc

SEQ ID NO: 1537 - DNA, 661 bp, Homo sapiens
gcaggcccatattcagccacctcatccaggccttatcaaagaagagtcttatatgagatcaaatggctgcctttccccacaagattatatttttcctggtatgctctactttgacacatgtggctttctcaggtggaacaatataatcacaaggattcttatcagagggaggcaggagggcccaagtcagagaagatgtgacaatggaagcagaagttagaatggtgcagtaaaagggccatgggccgaggaactcagacagcctgtagaagctggaaaagcaggaattttcaataaacgtgacttcactaggtggcctaagccccgatgtaaaatgtatatcccactggaccctgattacaatgcagactgccccaatgtgacagcacctgtttgtgcctcaaatggccacactttccagaatgagtgtttcttttgtgttgaacagagggaatttcattatcgtataaaatttgaaaaatatggaaaatgtgattaatgggtaccagagtaactacacttgcttattctttttctacttaattcagaatagtatttcttttagagtgtgagaatgtaaattaaataacatccctatgctgtacttaaatgtcgaacaaaatgagagacaaaaatgaaggaatcaaactgacaagaacca

SEQ ID NO: 1538 - DNA, 560 bp, Homo sapiens
ctttttaaggtaagtggggagaggaaagcaatgccccagagacccgacgccttagcccgccaccctgagacctagcacaaggagcgttcacgcccgaagggtcatccgagatgggggctcgaggcacgcgcccccaaatcttcaaggcccaagaagcttctcaagggcgccctatccgtaggagctgagggcatgaggggcaggagcaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaagaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagat

SEQ ID NO: 1539 - DNA, 547 bp, Homo sapiens
agaagtaggaggggcgtcttcccctcgtgggccctgagcgggactgcagccagccccctggggcgccagctttggagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcagg

SEQ ID NO: 1540 - DNA, 1377 bp, Homo sapiens
tttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagagtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcagtgttcttatattacctactgttagtatttattgtttaccactatgttaatgcagggaaaagttgcacgtgtattattaaatattaggtagaaatcataccatgctactttgtacatataagtattttattcctgctt

SEQ ID NO: 1541 - DNA, 587 bp, Homo sapiens
aaaaagacatcaagtcctttcatgctgtcctgggaaaggcggtttggaacaagttatcctgattctagagacgatgcaaagcactgtgctaggcaccaggagaatgcagaaagggcacatccccttccttcaaggagtttacagctttctcagaagcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattg

SEQ ID NO: 1542 - DNA, 572 bp, Homo sapiens
agtgcggaggaactgagccccgggaggaggtgctcctgtgcagccccactgagtcagctcatctatcgcctgccctccacctggccagtccctgcgggcatctaactgctaagcctccgctcagccaacacccagttggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaag

SEQ ID NO: 1543 - DNA, 623 bp, Homo sapiens
gcttttgtgtacttgtctggttgggacttcgtgtttctttcttgggattgttgtctgggactgcaagcaggagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggct

SEQ ID NO: 1544 - DNA, 539 bp, Homo sapiens
ccagaggcaggcgcccaagctcgctggctgttgctgagggcctgtaggtgtgtccaggactgagtggtgtggtggagacagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcagga

SEQ ID NO: 1545 - DNA, 1022 bp, Homo sapiens
acaaaagagtgctaactactctaggagagattaaagcctgtgaaatagaacttttccagataatggcgagtttttaggcttgctcatgctgaagcttaatataagctaataagtagagaaattaggaggcttggatattgcaaactttattggttggggtgttacccaggctaatagaaaaaaaattatatcctagaaagacagaacaggtgcgacttctgagaagaaaggttagagaagactagaaaggctgggaccaccttgaatttggcacacacacacacacacccacacgcacacacaaaatcaccaaatgatctggaatgtgctatgcgatgagtcagcctccactgctgtacgtccttggctacagactcctggaacagcagctcttctcaaggctagttgtgacagactcctggaacagcagctcttctcaaggctagttgtgacatccaaagtgacaagagcaggcccatattcagccacctcatccaggccttatcaaagaagagtcttatatgagatcaaatggctgcctttccccacaagattatatttttcctggtatgctctactttgacacatgtggctttctcaggaattttcaataaacgtgacttcactaggtggcctaagccccgatgtaaaatgtatatcccactggaccctgattacaatgcagactgccccaatgtgacagcacctgtttgtgcctcaaatggccacactttccagaatgagtgtttcttttgtgttgaacagagggaatttcattatcgtataaaatttgaaaaatatggaaaatgtgattaatgggtaccagagtaactacacttgcttattctttttctacttaattcagaatagtatttcttttagagtgtgagaatgtaaattaaataacatccctatgctgtacttaaatgtcgaacaaaatgagagacaaaaatgaaggaatcaaactgacaagaaccaaatatcacatttgttacaaataaacaacaaaagagctgatattc

SEQ ID NO: 1546 - DNA, 604 bp, Homo sapiens
cgttgggagcccaggggaatcagggcctgggcgtctggacccccgggtcccttagaacgcccttcagagagaggaactgagaggagaaggagaagagagtgggcccgccttcagggtctggggccttccaggttgggtcgtaggggcgggagcgcacaggctgcgagagaggagcaaaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagct

SEQ ID NO: 1547 - DNA, 2882 bp, Homo sapiens
atgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagag

SEQ ID NO: 1548 - DNA, 569 bp, Homo sapiens
tttcggttcctggaaaggttaccggagctgcgattggggctgggaccaaagttgagtcctggaaagggagcctggagagcggcggtgctgggaggcccggccagctcgatcgcaggcttccacctggcggccagtccccggatgcgcaccccaacggcgcctgcgcctacgggggcctcagccttgcaaaatgtcactcagcagagcctgctgctgaaacgtgggagttgaaaaagatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataagattgaagagcaatcagattgtaagatcttagatggacactttgtttcccccatggctcactatgtgcctgatatcatgccaattgaatctgttattgcaaggttccaatttattgtgcctaaagaatggaacagcaaat

SEQ ID NO: 1549 - DNA, 300 bp, Homo sapiens
gtagtgaaactttagaaagaagagccgggaggatgtattggttgttaggaaaatgtaggctaccagtagaaaatgacattctctattaataagatctgagggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggaccccaaggtctactgcactc

SEQ ID NO: 1550 - DNA, 676 bp, Homo sapiens
agagaaccacatactatgtaacctcctttttctgttctgtcccagcgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccc

SEQ ID NO: 1551 - DNA, 2362 bp, Homo sapiens
agaagggagcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcagtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtgaaattgacttaccctcttcacttaagttagttctggcctgacctgaactctgacttttactgccattcactttataaaataa

SEQ ID NO: 1552 - DNA, 478 bp, Homo sapiens
agcgacggagctggggccggcctgggaccatgggcgtgagtgcaatctacggatcagtctctgatggtgggtcgttaacctcagtggggactccaagatttccatgaagaaaatcagttgtcttcattcaagaattggggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattc

SEQ ID NO: 1553 - DNA, 573 bp, Homo sapiens
agagcacctgagaggatctcggcgaagcggaaggctttggtgccagctgggagagtctgcgccggatttcctcagctccttggcgcgtttcctcggagccgggggaggcaaagcacggaccccggagtcggcgcccatagcgggacgccctcgcgaggggcgggagtgcgggagagccgagctgctgcccttgactggtgctcaggggaccacagctgcaatgacagtttgggcctgcaaaaagaaggctggaacaacgggagatggaagctttctgcaaatgcaccactggtatccatgaatttaacctgcccatcattcttcctaaacaagagactattgaaaagtcagggtgttcaaaatggcttcagatcttatcaggacaatcttggctgttgcactaatttccaaacttggcacagctgtagatgcagaactgatgccatctggtgcgattctacagaataagagagaaaatttacccagagtgtgccatgcactggcttttctgggaatggcaaggtgccaggatttgtttttggttcgcttgcaggggtggaaacttggaactag

SEQ ID NO: 1554 - DNA, 580 bp, Homo sapiens
gtgtttctttcttgggattgttgtctgggactgcaagcagggtatgtttttatctactgtgaggttcctggggcggagatgtgcagtggagcgagaacttcctgtgaccgtgacattgtctagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcagg

SEQ ID NO: 1555 - DNA, 573 bp, Homo sapiens
gaacaatttatctgcacgaataccccgtgctaccagaatggctgtctcagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacgtaagcactgagaaaaacgttgctttttgtccaattctctgttgataatgaccacacaatgacctcatggcattaaaatacatgagaaacaaaatttgtggcataagtaaatgtgttatttttcattgaaaaatgttgccctacttaaaatatattttgcatctgaatcaactgccctgagctttttgggggaaaggacattcccatcaagtggttccatacaggatttttttttttttttctttttaatctcaggagcaaatagggaggaggaagaacactagactaaggaacaaaaagccaagttctgatcctaactca

SEQ ID NO: 1556 - DNA, 564 bp, Homo sapiens
agagtttccctctattgtgcaccccggtctgcttgacagtgtgatggtcccgcgtgcgcgtctcctgggttttgcagctttgtcgggggctcggtgggcctccttcattctccccgagtggcgctaaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaagaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagatcattaatgaggaaggcactgagttattctcctacaaaggcaatgatgttgagtattttatatcgtctagttccccatccggttta

SEQ ID NO: 1557 - DNA, 956 bp, Homo sapiens
cagttgctttgcctactcagtctcactgtttcatcttccctgggtctcttggtccccttccttttgactgtgtgtgattttcagtgtgcctccatccttctcctgctcctcttcttcctcctcccgaccactcaactttgtcctggcctcatttttggcctcttctggccagtgatcagaccctctggcccactacggccagagctggctgggcctgagggaggcttgccctgaggactcctgagtccccctcccactccactccgttgggagcccaggggaatcagggcctgggcgtctggacccccgggtcccttagaacgcccttcagagagaggaactgagaggagaaggagaagagagtgggcccgccttcagggtctggggccttccaggttgggtcgtaggggcgggagcgcacaggctgcgagagaggagcaaaggttggtggagggagaagagcagtctggggcctggctggacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagt

SEQ ID NO: 1558 - DNA, 2092 bp, Homo sapiens
aggaaactccaaactgttctccataatggctgtgctaatttacattttcatcaacagtgtacgagggttctccgttttctgcactcttgccagcatccgttttttcctgtctttttgataaaaaccactttaactgggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtaagaccaggtgcctccagaactcagagtggctgctcttagatcaacatatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccagcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctccagctggacttgaacatgagcctcggacagagactcaaagaaccgcgggtggatttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcccataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcctattagttgtcataataatggttttgtaactcatatgaaataaaatcagaatgt

SEQ ID NO: 1559 - DNA, 430 bp, Homo sapiens
tttggagatattgaatcatgttaccatttctgtttttttccaccctgttttcttccatatttactgaagctcagaagcagtattgggtctgcaactcatccgatgcaagtatttcatacacctactgtgggagagatttaaagcaattatatttcaatctctatataactgtcaacaccatgaatcttccaaagcgcaaagaagttatttgccgaggatctgatgacgattactctttttgcagagctctgaagggagagactgtgaatacaacaatatcattctccttcaagggaataaaattttctaagggaaaatacaaatgtgttgttgaagctatttctgggagcccagaagaaatgctcttttgcttggagtttgtcatcctacaccaacctaattcaaattagaataaattgagtatttaaaa

SEQ ID NO: 1560 - DNA, 553 bp, Homo sapiens
agaaacgctggggcgcccaccctggcagactaacgaagcagctcccttcccaccccaactgcaggtctaattttggacgctttgcctgccatttcttccaggttgagggagccgcagaggcggaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgg

SEQ ID NO: 1561 - DNA, 1845 bp, Homo sapiens
ggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaagaactaccttaaattaatttgttgaaaggacagatggatggatggttgatggaagtagcaggcttccagcagcaggggatggagtgagtgtgtggataccgctggatcagcagaaggttataccattttagagtaactatctcggacttcggagagttcctggataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttaca

SEQ ID NO: 1562 - DNA, 1439 bp, Homo sapiens
ccagcttccagcctaccctgcatctcttccctctgaattgcaggaaccctcccagcctccatgccgcctttcctgatcaccctcttcctctttcactcttgctgcctccgagcaaatggccacctccgtgaaggaatgacattgctgaagactgagtttgcacttcacctctaccagagtgtggccgcgtgtagaaatgagacgaactttgtcatctctcctgctggtgtgtccctccccctggagatcctgcagtttggagcagaagggagcactggtcagcagctggcagatgccctggggtacactgtccatgacaaaagggtgaaagatttcttgcatgctgtttatgccacactacccacctccagccaaggcaccgagatggagctggcctgcagcctttttgtgcaagtgggaacgccactgtccccctgctttgtggagcacgtctcctggtgggctaacagcagcctggaaccagccgacctcagtgagcccaatagcaccgccatccagactagcgaaggggcctccagagagactgcaggtgggggccccagtgagggccctggtggctggccgtgggagcaagtcagtgcagcatttgctcagcttgtgcttgtgagcaccatgtccttccaaggcacttggcgaaagagattctcctccacagacacacagatcctgcctttcacctgtgcctatggcctcgtccttcaggtccccatgatgcaccaaacgaccgaggtcaactacggtcagttccaggacactgcaggccatcaggtgggggtgctggagcttccttacctgggaagtgcagtgagtctgttcctggtgctgccccgtgacaaagacacccccctgagccacatcgagccacacctcacagccagcaccatccacctctggaccaccagcctgaggagagccaggatggatgtgttcctgcccaggtttaggatccaaaatcaattcaacttaaaaagcattttaaattcttggggagtcaccgatctttttgatccactcaaagctaacttgaaaggaatttcaggccaagatggcttttatgtttctgaagcaatccacaaggccaagattgaagttttggaggaaggcaccaaggcatctggagccacagctctgttgttattgaaaaggtctcggattcctatttttaaagcagatcggccattcatctatttcctgagagaacctaacacaggtattacagtattttttgacaggattcagataatttatcagtgtctctctagcaacaagggctcatttgtccactatcccctcaaaaataagcattctttctagctgtttttatggtgcttcagaagctacccagttgctatcttctatcctaagaaaggggactatttcgtaagtacaaaggaaacttatcctccatgttttttacc

SEQ ID NO: 1563 - DNA, 2258 bp, Homo sapiens
agctggcaacggtagaggaaagtggtgaactcatttgacttttctttatcagctgtaccatgtacatgatgtgcaagaggactggggctctgtgtcaaggccagctgggatgctgaggttttgtgttaggaccaagggcaagtctgatggctgttctggtttgccctgcttcatgccatggcctaaaggagtttaggataagaaggggaatgtggagattgtgcctggtttactatttttatccagcctcctcaactttgtatgtattgaggattgatgtcttaaactacacttccaaagatgaggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacatatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccagcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctccagctggacttgaacatgagcctcggacagagactcaaagaaccgcgggtggatttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcccataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcctattagttgtcataataatggttttgtaactcatatgaaataaaatcagaatgtaaaatagg

SEQ ID NO: 1564 - DNA, 2100 bp, Homo sapiens
agaacgctggacaatccagtaaaggtgctgctggtaataaaacatgaaactatatcttatgcttggtcaagacgtgtcaaatctgtatctgaaatagtgaatgaatgagatcagatgttgtccagagaaggaaaatcaaatgataaaagtgttgagagaggggcagctcttgaaggaagatggaataagaacatggaaactcctgtgtggaaagaaaaggccaagaggtctgctaaatcaagagtactgtgaataaacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatg

SEQ ID NO: 1565 - DNA, 1413 bp, Homo sapiens
tcacttggtgtgtctatatgtctggcagacattatcagcacattctctgttgttacctgtgattcattttttcttcactctccaggtgaatttcaattgctgaaaatttcccactgaaaatatgcagtaatatattttgtggttcagacatttggggcaaatggttcacattcattttagggttagtggtcatgctgtttatttttctctgctatacaaagttcctcttaggggtctgcctcatgacactaaaaaatgaatagagattctactgtaggttatctcctaggcttgagttcaacatttgtttggatttttgaagaaagtcaaatcaagcaatgctcccaaatgatgtctttgtaaattcataccctctggccctattttttttcatagaccctaactctacctttctgctttaaagcaaagtaaactcggtggcctcttcttctccacccctcaaaatgatagcaatctctgccgtcagcagtgcactcctgttctcccttctctgtgaagcaagtaccgtcgtcctactcaattccactgactcatccccgccaaccaataatttcactgatattgaagcagctctgaaagcacaattagattcagcggatatccccaaagccaggcggaagcgctacatttcgcagaatgacatgatcgccattcttgattatcataatcaagttcggggcaaagtgttcccaccggcagcaaatatggaatatatggtttgggatgaaaatcttgcaaaatcggcagaggcttgggcggctacttgcatttgggaccatggaccttcttacttactgagatttttgggccaaaatctatctgtacgcactggaagatatcgctctattctccagttggtcaagccatggtatgatgaagtgaaagattatgcttttccatatccccaggattgcaaccccagatgtcctatgagatgttttggtcccatgtgcacacattatacgcagatggtttgggccacttccaatcggataggatgcgcaattcatacttgccaaaacatgaatgtttggggatctgtgtggcgacgtgcagtttacttggtatgcaactatgccccaaagggcaattggattggagaagcaccatataaagtaggggtaccatgttcatcttgtcctccaagttatgggggatcttgtactgacaatctgtgttttccaggagttacgtcaaactacctgtactggtttaaataagtttaccttttcctccaggaaatataatgatttctgggaacatgggcatgtatatatatatatggagagagaattttgcacatattatacatattttgtgctaatcttgttttcctcttagtattcctttgtataaattagtgtttgtctagcatgtttgtttaatcctttg

SEQ ID NO: 1566 - DNA, 2293 bp, Homo sapiens
atcagatgcatgcatagcaccacacagctacatcttaaaaaacgtagtgtttactcaaaaacattagggaataacgaaatacataacataaaagcaggaggaggggggaagcattaggtacctggtacccagcaaaagcccaacaagcaaagttatcagtggaattcctcaatgtgacaaagggctggatgaggggttccttgctggtacaaccaggtcacaagcctaagaaggcttgacgggtgtggctggctctccccccacggccctgctctgttcccgatctgggctttgctgccctgggctgggctgcttctcctggctctctgcaggacctccaggctccaggaatttggaccgagtggtagagacatcgccggcagagacggcaatcgccagcttcctctctgtgctgtcttgtgattcaaagcagattctgctccacttttttaaaaggggagcacatgaatgctggagacccacaagaacagagtcgagcaaggaaacgtgcaacagtgatacaaaagtctggctttgctaaagtcacacatccagtaagtggccgaagcagatcttcagacccacagtttggctgccaaaggaccacagaaccctcccagcctccatgccgcctttcctgatcaccctcttcctctttcactcttgctgcctccgagcaaatggccacctccgtgaaggaatgacattgctgaagactgagtttgcacttcacctctaccagagtgtggccgcgtgtagaaatgagacgaactttgtcatctctcctgctggtgtgtccctccccctggagatcctgcagtttggagcagaagggagcactggtcagcagctggcagatgccctggggtacactgtccatgacaaaagggtgaaagatttcttgcatgctgtttatgccacactacccacctccagccaaggcaccgagatggagctggcctgcagcctttttgtgcaagtgggaacgccactgtccccctgctttgtggagcacgtctcctggtgggctaacagcagcctggaaccagccgacctcagtgagcccaatagcaccgccatccagactagcgaaggggcctccagagagactgcaggtgggggccccagtgagggccctggtggctggccgtgggagcaagtcagtgcagcatttgctcagcttgtgcttgtgagcaccatgtccttccaaggcacttggcgaaagagattctcctccacagacacacagatcctgcctttcacctgtgcctatggcctcgtccttcaggtccccatgatgcaccaaacgaccgaggtcaactacggtcagttccaggacactgcaggccatcaggtgggggtgctggagcttccttacctgggaagtgcagtgagtctgttcctggtgctgccccgtgacaaagacacccccctgagccacatcgagccacacctcacagccagcaccatccacctctggaccaccagcctgaggagagccaggatggatgtgttcctgcccaggtttaggatccaaaatcaattcaacttaaaaagcattttaaattcttggggagtcaccgatctttttgatccactcaaagctaacttgaaaggaatttcaggccaagatggcttttatgtttctgaagcaatccacaaggccaagattgaagttttggaggaaggcaccaaggcatctggagccacagctctgttgttattgaaaaggtctcggattcctatttttaaagcagatcggccattcatctatttcctgagagaacctaacacagggtttgtcttcagtattgggagagtttcaaatcccctagactaaatgcatgttctccactttcatcaatgcttttcttcataaagttataatttcattttgctatacccttgaaatttaaaaaaatgtctgataaagtgtaaaaagctaagggtatgtgattttcaatattataaacctaaaaatacttcagtttttaaatgttataagtttattttgcctactcttaatccaaatctattttgaccttcttttctactgcttaccccccaaaccactaaaaggcacagcagtgatcatgaatggtgagtgagtcaggccataagattgcttcctcagtacggatactctaggccatgttgaattgagggtggagaatgaatagcgtggttttccttatcctgtgaaactcaggggggatgcaaaatgagcaaagtcatcttaaaggtgtttcctttccatttagcttataaataaaacagagtttaagtgtgagaa

SEQ ID NO: 1567 - DNA, 1435 bp, Homo sapiens
aacagatttctctttccacccatctattgcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcaacaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggtaacagtccaggctggagctgggagtgggcagacagctgggcagaacagggcacaggagactgggggagatcatcttcacatatttggactaatcctttctcatgctcctttggctcttctgccatgttttcttagcaattaggctggttctgcccttttcataggcttcccatagacttttaaagtaataataataatattgataaattttggctaccatttattgagcatagtatgagctaaagactttcattacatatatatta

SEQ ID NO: 1568 - DNA, 995 bp, Homo sapiens
ccgagcccgagccatggcgtccgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatgaacccatctgcgccgtcggccacggtgtcgccgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccactgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtggtcactgttgactagacagagtcggctcgggggtcctctgtgtgggtttgccctgctgtggcctgtctgccacccaccacctctttcactgttggtgggg

SEQ ID NO: 1569 - DNA, 3391 bp, Homo sapiens
aatctgggggtgcgcgagggagtaagaggggcgaggggaccctgcgaagcgttgggtgccgagccagagcctacaaattggagtcctcggcactttgggggccgctggagggtttggaatcgagagcccagggctagccagtgatggtgccagctgagggctagggcggagatcggagccgggttgggagtccgtgcactcggaggactgggaaaaagtgcagggacccctaaaaggtggtggtggcagatacgagactaggtgctgtgtaaagggggctgggggcagagagcagagcctctgcggaaagaaacagaggaggaaggagatgggtctggtgcctcttcccgcaagggtagggaggataggccggcctcgcagttccaggtcacttccgttctggggttgaggctcaggggcagcggtgattggtggcccagcctcctcacaggcttgctgagggaatttgagcttccggtggtgggaaaggaggtgaaatcgtctcgactcctggggtccgtgtgctctggtagaagtgggcgacagtggctcaatttctgatcagcagcttgcagcctagatgatggcagccaaaggaaagacttggccagcgaggctccctaccactccgaaaaaagagagtgggggtcagcagggtctgctctgctctggggattaaggggctgactagaaggatttgagtctttccttctgtccactgccacagggttcttggagtaactgcagggtttaaactgcagggtctaacttccagaggctggggttccctgccccccagcttagagacattcctgaggtggctgaagagcaggaaggagaatgaatgcacttccagactggcccagagtctcagcccctcctcttccttgtttcccgctggtccctctgggctgtacggcccggatggaggcctgaggaaaatgagggggctttggttctccggaattccggccggggccacaccctcctgtcttcagatggttcatgtacccatccccccttcccgtcctctcctttgtctcctctgtcaccgggactcccagcagagattttttttttgtactggctgtgtaacaggacaccgcatgcagccctcaggaggggctctgtgcttctgtgaggaaggacccctgtgctgggaaggcagacccctgtttatcccgagggacctggggtgaccccctgccctggccttgtttctcccattttacagtgaggtggtcgatctccaaggtccctgtagattggggactggttgtgccctctgcgccaggggcctcctcaccatctctcctttgccggctcccgccctcttcactcttctgttttctttcagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgac

SEQ ID NO: 1570 - DNA, 1582 bp, Homo sapiens
ctcctccgcagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgacagttgaaattgacttattggaaatattaactaaagcccatattagaccataa

SEQ ID NO: 1571 - DNA, 609 bp, Homo sapiens
gtgcttcaaacgccttgaggataaggaaggagaatcagcaagtcccgagttcctacggtgtgtcagcatcgtgctcccactcccgggagagaggcattatcttcagtttacaaaaggggaaaacaggtctggggtttccagagtccgcggttttgctaagaagccgcagtgatgttgacgcggctggtcctcagtgcacacctgagtagcacgacctctccgccctggacgcacgctgccatcagctgggagctggacaacgtgctgatgcctagtcccagaatctggccccaggtgactccaacaggcaggtctgcctctgtcaggagtgagggtaacacctcctcactctggaatttctcagctgggcaggatgtgcatgccatagtaaccagaacctgtgagtctgtgctgagctctgccgtctacacccacggctgtggctgtgtgaggtctgccacaaacattacctgtcagtcctcaggacaacaaaggcaggcggcccggcaggaagaggagaactcaatctgcaaggcccatgatagtagagagggccgcctgggctaccccctcagtgcccatcagcctggttccggtggtcctaactag

SEQ ID NO: 1572 - DNA, 2781 bp, Homo sapiens
gatcttcgggggctccatccactatttccgtgtgcccagggagtactggagggaccgcctgctgaagatgaaggcctgtggcttgaacaccctcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttggccaccatcaacttgcagtcaacacacgagctgcagctactgaccacctttctcttcaacgtccaggggactcagcccaagatggtgatggagtactggacggggtggtttgactcgtggggaggccctcacaatatcttggattcttctgaggttttgaaaaccgtgtctgccattgtggacgccggctcctccatcaacctctacatgttccacggaggcaccaactttggcttcatgaatggagccatgcacttccatgactacaagtcagatgtcaccagctatgactatgatgctgtgctgacagaagccggcgattacacggccaagtacatgaagcttcgagacttcttcggctccatctcaggcatccctctccctcccccacctgaccttcttcccaagatgccgtatgagcccttaacgccagtcttgtacctgtctctgtgggacgccctcaagtacctgggggagccaatcaagtctgaaaagcccatcaacatggagaacctgccagtcaatgggggaaatggacagtccttcgggtacattctctatgagaccagcatcacctcgtctggcatcctcagtggccacgtgcatgatcgggggcaggtgtttgtgaacacagtatccataggattcttggactacaagacaacgaagattgctgtccccctgatccagggttacaccgtgctgaggatcttggtggagaatcgtgggcgagtcaactatggggagaatattgatgaccagcgcaaaggcttaattggaaatctctatctgaatgattcacccctgaaaaacttcagaatctatagcctggatatgaagaagagcttctttcagaggttcggcctggacaaatggagttccctcccagaaacacccacattacctgctttcttcttgggtagcttgtccatcagctccaccccttgtgacacctttctgaagctggagggctgggagaagggggttgtattcatcaatggccagaaccttggacgttactggaacattggaccccagaagacgctttacctcccaggtccctggttgagcagcggaatcaaccaggtcatcgtttttgaggagacgatggcgggccctgcattacagttcacggaaaccccccacctgggcaggaaccagtacattaagtgagcggtggcaccccctcctgctggtgccagtgggagactgccgcctcctcttgacctgaagcctggtggctgctgccccacccctcactgcaaaagcatctccttaagtagcaacctcagggactgggggctacagtctgcccctgtctcagctcaaaaccctaagcctgcagggaaaggtgggatggctctgggcctggctttgttgatgatggctttcctacagccctgctcttgtgccgaggctgtcgggctgtctctagggtgggagcagctaatcagatcgcccagcctttggccctcagaaaaagtgctgaaacgtgcccttgcactggacgtcacagccctgcgagcatctgctggactcaggcgtgctctttgctggttcctgggaggcttggccacatccctcatggccccattttatccccgaaatcctgggtgtgtcaccagtgtagagggtggggaaggggtgtctcacctgagctgactttgttcttccttcacaaccttctgagccttctttgggattctggaaggaactcggcgtgagaaacatgtgacttcccctttcccttcccactcgctgcttcccacagggtgacaggctgggctggagaaacagaaatcctcaccctgcgtcttcccaagttagcaggtgtctctggtgttcagtgaggaggacatgtgatcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcagtggcccccgccccccaccccccacgcccgaacagcaggggcagagcagccctccttcgaagtgtgtccaagtccgcatttgagccttgttctggggcccagcccaacacctggcttgggctcactgtcctgagttgcagtaaagctataaccttgaatcaca

SEQ ID NO: 1573 - DNA, 523 bp, Homo sapiens
ccggccgtgcgtttgtggccgtccggcctccctgacatgcagatttccacccagaagacagagaaggagccagtggtcatggaatgggctggggtcaaagactgggtgcctgggagctgaggcagccaccgtttcagcctggccagcctctcggaactgccgtggctgttcaagcactcactgcctttgcctgtggctccatgtactgggtgctgctgtgcttgccctccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtcgtgacggacctcaaagctgagagtgtggttcttgagcatcgcagctactgctcggcaaaggcccgggacagacactttgctggggatgtactgggctat

SEQ ID NO: 1574 - DNA, 974 bp, Homo sapiens
gaaatcgtctcgactcctggggtccgtgtgctctggtagaagtgggcgacagtggctcaatttctgatcagcagcttgcagcctagatgatggcagccaaaggaaagacttggccagcgaggctccctaccactccgaaaaaagagagtggggaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacga

SEQ ID NO: 1575 - DNA, 438 bp, Homo sapiens
agacacaaacccagccccaaaggccccacagccaccaggcacctccaacaaccaggtgtgagtaatttttttttttttttgagacagggtcctatctgtcgcccaggctggagtgcagcagtgcaatcacagctcactgcagccttgatgtcctgggctcaagtgatcagcctcccgaagtgctgggattacggcgtgagccaccactcccagccttcgagtgcttttgaggatgtctgtgagaggcatcctcaggctggggacccaggaatatcccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaaggtaag

SEQ ID NO: 1576 - DNA, 882 bp, Homo sapiens
ggagcgggctaagagtagaatcgtgtcgcggctcgagagcgagagtcacgtcccggcgctagcccagcccgacccaggtgaggggcgggagacgcctgcgcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaa

SEQ ID NO: 1577 - DNA, 1059 bp, Homo sapiens
ctgttccctgacagccgatgtcagaccctgccactagcctccttaacagaagttcccagccatgaagcctctccttgttgtgtttgtctttcttttcctttgggatccagtgctggcaggtataaattcattatcatcagaaatgcacaagaaatgctataaaaatggcatctgcagacttgaatgctatgagagtgaaatgttagttgcctactgtatgtttcagctggagtgctgtgtcaaaggaaatcctgcaccctgacataagaaaccaatgaatggccactatcctgtaggcccttgattctgccatctttcacaaaaccagggaatttagatcaaactgtgacaccatgatgtgtccatgactactggtttttagcatttttataggccagcagactcttgtggtcttaaatttaaagagctgagctgtagccttctttaaaagagctcggtttttcacaaaaacaatgtagaagatattttctcacctcaacgtgatgtccagtgtgctcatcagcacctgtttctccctctaatcatagaggatattcttattatttagaaaggcttcaagggaaacaacttttgacacctaagtcgtgtcctaccttcgcttcagcttcgcatttcccatttctgtgaaattcccaactttagagaagcagatttgccatggccttctgacaaccttgtacatctctcacataaaccgcataggcagggcttaactacaggctggcccgagtctgcactgagtctgaccctgaagttcctttggaacaggagaggccatcttgtgatgggctggaacaaggtaatttctcatccacctccctagtttcagttgagcaatggaacttcccacctgagcccctagggttcagctacaggctataagactgccgtcctgtggtttagtgttggttccttagcagcagagtgatgccacctctgctgcccgtcatctgactcctctggatgggtgttatcctgtggcttaagagctaacaccatgctgatcttgctttgctatatgtgtaactaataaactgc

SEQ ID NO: 1578 - DNA, 1967 bp, Homo sapiens
cagaaggagatggtgagaagaaccacaccagagaggctggagtaggccagcctggcttgggaccgagtcccgagtccctggctggaccctcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagctgaccggacacctgtggctcttatttcctaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 1579 - DNA, 1050 bp, Homo sapiens
agccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggctcctgctccagcccagcccccagagagcagaccccaggtgctggccccgggggttttggtctgagcctcagtcactgtgttatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgac

SEQ ID NO: 1580 - DNA, 1623 bp, Homo sapiens
tctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaagagatggagtcttactatgttgaccagcctggtctccatctcctggcttcgggcgatcctcccatgtcagcctcccaaagtgctaggattataggcatgaggcactacaccagccaacagaagtttttatattaaaatttactttttctagctgggcacagtggctcacgcctgtcatcccagcactttgggaggctgaggcaggtggatcaccggtcgggagtttgagaccagcttggctaacatggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtc

SEQ ID NO: 1581 - DNA, 873 bp, Homo sapiens
acgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgcc

SEQ ID NO: 1582 - DNA, 613 bp, Homo sapiens
attgcctctgtcagtgtgacaggttccacagagctgtcaccctgcaaactcacccttcctccaggagcacaggcgcagagctgcagtggagggtacctgtgtggcttccttgtctgacacagatttgccttcatctgaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtga

SEQ ID NO: 1583 - DNA, 1386 bp, Homo sapiens
acacttaacccatctgttttctctaatgcacgacagattcctttcagacaggacaactgtgatatttcagttcctgattgtaaatacctcctaagcctgaagcttctgttactagccattgtgagcttcagtttcttcatctgcaaaatgggcataatacaatctattcttgccacatcaagggattgttattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcatcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccc

SEQ ID NO: 1584 - DNA, 1533 bp, Homo sapiens
gagggaacatctggaacattagacagggtaagccacctttgcaactcctttccccctgctgtgacgtacagatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacagggttggatcctgtagaagcaagtttcgagagtactcctgaagaggtgcgacttgatccctctgatgctgactttgttgatgtgattcacacggatgcagctcccctgatcccattcttgggttttggaacgaaccaacagatgggtcatcttgacttcttccccaatggaggagagagcatgccgggatgcaagaagaatgccctgtctcagatcgtggatctagatggcatctgggcgggaacccgggactttgtggcttgcaatcacctaagaagctacaagtattacttggaaagcatcctcaatcccgatgggtttgctgcatatccctgcacttcctacaagtcctttgagtctgacaagtgcttcccgtgtccagatcaaggatgcccacagatgggtcactatgctgataaatttgctggcaggacaagtgaagagcagcagaaattcttcttgaacacaggagaggctagcaatttcgctcgctggagatatggggtttccatcacactgtctggaagaacagccactggtcagatcaaagttgctttgtttggaaataagggaaacactcaccagtacagtatcttcagggggattctcaaaccaggctcaacccattcctatgagtttgatgcaaagctggatgttggaacaattgagaaagtcaagtttctttggaataacaatgtgataaatccaaccctccccaaagtgggtgccaccaagatcactgtgcaaaagggagaagagaagacagtgtacaacttctgtagcgaagacacagtgcgggaagacacgctgctcaccctcacgccctgctaagctcccggggcgacgaggctgctgcgttcacactaataaaatccactggtgcatctgt

SEQ ID NO: 1585 - DNA, 594 bp, Homo sapiens
acagccaccaggcacctccaacaaccaggtgtgagtaatttttttttttttttgagacagggtcctatctgtcgcccaggctggagtgcagcagtgcaatcacagctcactgcagccttgatgtcctgggctcaagtgatcagcctcccgaagtgctgggattacggcgtgagccaccactcccagccttcgagtgcttttgaggatgtctgtgagaggcatcctcaggctggggacccaggaatatcccaggtaaggcatggggtctcctaaagcagggatccagtcagcagcagaaacactcatctctgcaggcctcctcaccccaccggcctgcccctgccctactctgtcccccccatgcccacggcagacaggcagtgggcaagcaggagggcctcagggcaggtcagacctgggcctacagggcagagcctggacctccgccagggcactccacacccaccccggccctctggaccccgaggttggaccctactgtgacacacctaccatgcggacactcttcaacctcctctggcttgccctggcctgcagccctgttcacactaccctgtcaaagtcagatgccaa

SEQ ID NO: 1586 - DNA, 1153 bp, Homo sapiens
cttccgtcgctgctgtagtcgcttcctgcggccagcccgggttcaatcagcggccgacaactgtctagggctcagacaccaccagccaatgagggagggcagcgtggagccgcccgtctgggctcgcggctcctggaccaatggggaagtggcatgtgggagggcgccggggggccccccgccaatggggagctacggcgcgcggccgggacttggaggcggtgcggcgcggcgggtgcggttcagtcggtcggcggcggcagcggaggaggaggaggaggaggaggaggaggaggatgaggaggatgtgggccacgcaggggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttgtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtccttgcagaattatagtgaataccaaaatggggttttgccccaggaggctccta

SEQ ID NO: 1587 - DNA, 481 bp, Homo sapiens
catatttgtgctccttcacgggagggcagggaggttcaacggaccttaaaacatgaaggtcttttttctgtttgctgttctcttttgtttggtccaaacaaactcagtgcacatctctcaccgggaggctcgaggaccctcatttaggatctgtgtggactttttagggcctagatgggccaggggatgttccaccgggaattagaaataccatctgccatatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaa

SEQ ID NO: 1588 - DNA, 946 bp, Homo sapiens
aggtgcctggtaaacaatagctgttgtcgggtgtggtggctcacacttgtaatctcagcactttgggaggccaaggcaggaggggcgcttgagcccaggaattcaagaccagcctgggtcagagttggcattgctcaaatctgggcttcatttccaagaagtttcacaagtctgccaggggaagtccctggacttcttgcttctttcgtgtaggacaggctgtcgaaacctcagtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagcc

SEQ ID NO: 1589 - DNA, 1431 bp, Homo sapiens
gtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaaggtgaagttttgctcttgttgcccaggctggagcgcaatggcgcgatcttggctcaccgcaacctctgccacccagagtcagttttcagataagccggtgcaagaccggggtttggtcgtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtg

SEQ ID NO: 1590 - DNA, 773 bp, Homo sapiens
cgggactcccagcagagattttttttttgtactggctgtgtaacaggacaccgcatgcagccctcaggaggggctctgtgcttctaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgcca

SEQ ID NO: 1591 - DNA, 587 bp, Homo sapiens
tgagggaatttgagcttccggtggtgggaaaggaggtgaaatcgtctcgactcctggggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgac

SEQ ID NO: 1592 - DNA, 870 bp, Homo sapiens
cgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtg

SEQ ID NO: 1593 - DNA, 727 bp, Homo sapiens
cgactagcgggcgcggcccccagggtggactccccgccagccccggcctggaggctccgcccgcccccgcctgggcggaaggaacgcggagcggctctggccttgggtctgcggcggcggcgtcgggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctg

SEQ ID NO: 1594 - DNA, 2084 bp, Homo sapiens
ggttcctgggcgctctgttacacaagcaagatacagccagccccacctaattttgtttccctggcaccctcctgctcagtgcgacattgtcacacttaacccatctgttttctctaatgcacgacagattcctttcagacaggacaactgtgatatttcagttcctgattgtaaatacctcctaagcctgaagcttctgttactagccattgtgagcttcagtttcttcatctgcaaaatgggcataatacaatctattcttgccacatcaagggattgttattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcatcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaagaaaatagaaatacaggaatagtattcggggccattttaggtgctattctgggtgtctcattgcttactcttgtgggctacttgttgtgtggaaaaaggaaaacggattcattttcccatcggcgactttatgacgacagaaatgaaccagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaacaatgaagatgactctttactgctctgcctgaagccctagtaccataattcaagattgcattttcttaaatgaaaattgaaagggtgctttttaaagaaaatttgacttaaagctaaaaagaggacatagcccagagtttctgttattgggaaattgaggcaatagaaatgacagacctgtattctagtacgttataattttctagatcagcacacacatgatcagcccactgagttatgaagctgacaatgactgcattcaacggggccatggcaggaaagctgaccctacccaggaaagtaatagcttctttaaaagtcttcaaaggttttgggaattttaacttgtcttaatatatcttaggcttcaattatttgggtgccttaaaaactcaatgagaatcatggt

SEQ ID NO: 1595 - DNA, 602 bp, Homo sapiens
cccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaaga

SEQ ID NO: 1596 - DNA, 660 bp, Homo sapiens
aagagtagaatcgtgtcgcggctcgagagcgagagtcacgtcccggcgctagcccagcccgacccaggtgaggggcgggagacgcctgcgtgcgtgcggcccgggggagcgccgagcaatctgggggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcg

SEQ ID NO: 1597 - DNA, 1620 bp, Homo sapiens
aaaaagttgggggtggtttgtgttggggaaggcctgcgattggactgcagaatccactagggaggaggaaagcaaaagtaaaaaggaaatagctgggggaagggaacggggggaagccatcttcaccccccaccccaatgcacacacaattaagccaggaagcagcttgcaaccactagcctggggagggtccgcatgtgtcaagggtgagggcaacagatgctggacccagggagctctctgccacaggatgatggtggcccttcgaggagcttctgcattgctggttctgttccttgcagcttttctgcccccgccgcagtgtacccaggacccagccatggtgcattacatctaccagcgctttcgagtcttggagcaagggctggaaaaatgtacccaagcaacgagggcatacattcaagaattccaagagttctcaaaaaatatatctgtcatgctgggaagatgtcagacctacacaagtgagtacaagagtgcagtgggtaacttggcactgagagttgaacgtgcccaacgggagattgactacatacaataccttcgagaggctgacgagtgcatcgaatcagaggacaagacactggcagaaatgttgctccaagaagctgaagaagagaaaaagatccggactctgctgaatgcaagctgtgacaacatgctgatgggcataaagtctttgaaaatagtgaagaagatgatggacacacatggctcttggatgaaagatgctgtctataactctccaaaggtgtacttattaattggatccagaaacaacactgtttgggaatttgcaaacatacgggcattcatggaggataacaccaagccagctccccggaagcaaatcctaacactttcctggcagggaacaggccaagtgatctacaaaggttttctattttttcataaccaagcaacttctaatgagataatcaaatataacctgcagaagaggactgtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgcctta

SEQ ID NO: 1598 - DNA, 1358 bp, Homo sapiens
aagagtagaatcgtgtcgcggctcgagagcgagagtcacgtcccggcgctagcccagcccgacccagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcaggtaaggggtggcccagcctaggggcctgcaggccttggagccagggggaggtgcttgggggacccactcaccaattcagcaggtctgtcccaagaccccctggatgtccaggcagtgctgggctctgtgatgggggaagctggggcaggaggtgtgggccatgcccttgggaagatgatgataataccagcagctaaatataacggaacattcctgtatgctaggcgttcttctaagcactttatatgtattattatta

SEQ ID NO: 1599 - DNA, 1459 bp, Homo sapiens
gagccgcggggtcctcggccgcctgaccccagccggcgccgcgcctcccggagggggtcgggccctgcacgtgggcgcagcgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacagtttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctga

SEQ ID NO: 1600 - DNA, 571 bp, Homo sapiens
gttttccggccgtgcgtttgtggccgtccggcctccctgacatgcaggtgagccccgcggcggccggcccctgctcctcctccttgcacggcctcagtttccctcccgcaaagtgggcgcgccgggcagcgaggctcggccccgggaggacgggcgtggggtcgcgggcgacgccgggcggccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtcgtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacg

SEQ ID NO: 1601 - DNA, 2288 bp, Homo sapiens
attaaagccctgtgggccaagagttgtgataaccaacttggaatttcctgactcctatgcttactgatttttcccaacctgagttgaggggatggagagggatgtgtatgtgtgtagatgccctccatgcgctgtgttgaaaacgcgcgggtgactgcaggaaaccacagagcacagctcgggcctctactgatcgggaaacgtcggaagacagaaaaatgggcaatcataaaacccacggcaaccatgaagacacgcactctccccctagcaatcccaccccggaattgaggacacagggtccccgcgctcagcccttggtgccagcacttcttggacacctcaaccccctcagctaaacctgagatccaagcgctccggattccaaacgtttcctcgagcaggtcctctctagccggccgcttatctatggtttctgctatagggcgctctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccggcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccacccagaatgagccctgcagtcgacacctaccaatgcttagagacgcgtggtcggtgctgggggcgcggcctggagctgctgcctgtcccaccccaccagaagaggctgatcccgataggtatctgaccacattttttttttttttttttttttgagacggagtcaatgtcacccaggctggagtgcagtggcacgatctcggctcactgcaacctccgcccctgggttccagcaattctcctgcctcagcttcccgagtagccgggatcacaagtgcgcgccaccaagcccagctaacttttgtgtttttagttgagacagggttcaccatgttggctagactggtctcgaactccagacccaggtgatccgcccgcctcggcctcccaaagggctgggattacaggcgtgaaccacctcgccctgccgcggccacattttttcttttttttgagatggagtcttgctcttgtcacccaggcaggagtgcagtggcgcaatcttggctcactgcaacctctgcctcctgggttcaagctgttctccttactcagcctcccatgtagctgggattacaggcgtccgcaaccacgcccggctgatattagtagttttagtagaggcgggtttcaccatgtggccaggctgatctcgaactcctgacctcaggcagttcacccgtctcagcctcccaaagtgctgggattagaggcgtgagccactgcgcccggccaaccacattttcaaaacaggtcatgtggtgtcaggttggagtgtacttccagggataaccgtgggacattcttgaaatctgaactatcctgggaagtcttgaagtaatggatgcctatagtggacactcaggactcctgtccttggagcgagattggaggggcatctagcacttaacatatgccacaatgctttctgtggccattatttaacctctggttaaacaagcttaggaggctgacttactagtagtaaaaggagtgtgctttgagtcacagatcctggttgaactccagcatgttacaaacctcagccctgttctatgaaaggtcataactacgaggattattgtaaaacattaatttagaaatgtaaagtggtccccaatctctggatctggtcaggatttattggagctgccactgaggggattaaataagtggggtcaaagccccacagcctagtcaaccaa

SEQ ID NO: 1602 - DNA, 882 bp, Homo sapiens
ggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgac

SEQ ID NO: 1603 - DNA, 480 bp, Homo sapiens
agaggacttctgcaccgtttcccgaggacagtttggcagtgtttcagaagggccttagaaccaggcaggcccccttctaggatggtggaaagcctaaagatctgaaaacggtctcaagtgtcgtcttagcgattggctgactaaaccgaatgcaagccggagactgcacacgatgttgccgttaacagttacactgggccgggcagtcagaggcaggcggatcacctgaggtcaggagttcgagaacagcctggccaacatggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggccactcttcacctccaccatgagcctggacatccagagcctgga

SEQ ID NO: 1604 - DNA, 734 bp, Homo sapiens
agctactgtgagggctgttgaatttttctccaaagctcagatgcccagtattcctagtcttcgaaagagagagaggaagattgagagagagagagagagagagagagagagaagaagttttcttaatcagagatttctctttactttcaactaattgcagatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacag

SEQ ID NO: 1605 - DNA, 704 bp, Homo sapiens
gaggacagtttggcagtgtttcagaagggccttagaaccaggcaggcccccttctaggatggtggaaagcctaaagatctgaaaacggtctcaagtgtcgtcttagcgattggctgactaaaccgaatgcaagccggagactgcacacgatgttgccgttaacagttacactgggccgggcagtcagaggcaggcggatcacctgaggtcaggagttcgagaacagcctggccaacatgaggccaccttcttccatcttcaaaacctactgtctctgcataagaactctcatgattatatgccggccgcccagacaccccagggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctca

SEQ ID NO: 1606 - DNA, 1053 bp, Homo sapiens
agccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcagcaggctcctgctccagcccagcccccagagagcagaccccaggtgctggccccgggggttttggtctgagcctcagtcactgtgttatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgac

SEQ ID NO: 1607 - DNA, 1825 bp, Homo sapiens
ccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacc

SEQ ID NO: 1608 - DNA, 998 bp, Homo sapiens
gtgcggcccgggggagcgccgagcaatctggggaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaa

SEQ ID NO: 1609 - DNA, 752 bp, Homo sapiens
ctggtgtgtgtccctctcttcctgggcttccggcctctgaactagaatgtttcaaggcctaggagtgacaggacgtggtcagcaatagtggcccaggtcctgcccttgggtgacccaggccaaggtctcctagttagaacaggacagagtcacgaggctgccactgttgggaagggccctgcctgtgctgactctgcaaatgaggagtcgcccagagccgccgcgaccccacccaggagcactggccagcctggggaagacacaaacccagccccaaaggccccacagccaccaggcacctccaacaaccaggtccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtcgtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagg

SEQ ID NO: 1610 - DNA, 578 bp, Homo sapiens
gcactggccagcctggggaagacacaaacccagccccaaaggccccacagccaccaggcacctccaacaaccagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtcgtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgag

SEQ ID NO: 1611 - DNA, 582 bp, Homo sapiens
atttaaagaactcgccatcccacctgcacacccacgtagagacatctccccactgtgtttcagatgcctatggcgtcccctcaaaccctggtcctctatctgctggtcctggcagtcactgaagcctggggccaggaggcagtcatcccaggctgccacttgcaccccttcaatgtgacagtgcgaagtgaccgccaaggcacctgccagggctcccacgtggcacaggcctgtgtgggccactgtgagtccagcgccttcccttctcggtactctgtgctggtggccagtggttaccgacacaacatcacctccgtctctcagtgctgcaccatcagtggcctgaagaaggtcaaagtacagctgcagtgtgtggggagccggagggaggagctcgagatcttcacggccagggcctgccagtgtgacatgtgtcgcctctctcgctactagcccatcctctcccctccttcctcccctgggtcacagggcttgacgttctggtgggggaaacctgtgttcaagattcaaaaactggaaggagctccagccctgatggttacttgctatggaattttttta

SEQ ID NO: 1612 - DNA, 1829 bp, Homo sapiens
cgggtggggttgtcgacacgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggac

SEQ ID NO: 1613 - DNA, 582 bp, Homo sapiens
aatttgagcttccggtggtgggaaaggaggtgaaatcgtctcgactcctgggaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaa

SEQ ID NO: 1614 - DNA, 2299 bp, Homo sapiens
agtaggacccaggggccgggaggcgccggcagagggaggggccgggggccggggaggttttgagggaggtctttggctttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 1615 - DNA, 1919 bp, Homo sapiens
cgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgaga

SEQ ID NO: 1616 - DNA, 987 bp, Homo sapiens
atgtgtcctgcaggctggaagctcctggccatgttggctctggtcctggtcgtcatggtgtggtattccatctcccgggaagacagtttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctga

SEQ ID NO: 1617 - DNA, 1201 bp, Homo sapiens
atcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgcttcagttccactcccaggaactttgcctgtcccacgagggagtatgggagagagggactgccacacagaagctgaagacaacacctgcttcaggggaacacaggcgcttgaaaaagaaaagagagaacagcccataatgctcc

SEQ ID NO: 1618 - DNA, 2973 bp, Homo sapiens
cacaccctggtcggttttgctcacgtgcttcgggtcggttggattcagttcctccatgtggggccgtgggatgtcaccaccctttgccactgtccttgcaggccgggcgcccaggcgtgtggacccgagcccagccttgcgtctttcctcccagttggtaccaggggcctcttgcctccactcatgcagagtggaccagccgcctctgaagcagccccggggagaggagtgccaggcacacagactcaggaagctgggggtgtcagggcaccaggagcctctcaagcggtcctgttggccgtctttctgaagggcagctggggttgcatcatttccccaagtggatcctgccaactttctggggcttctggatgagagccctctccccaccccacccacccctccccgcattgtggcatcagtgctgctgcttccagggagccttcctggccatccaagcctcctctccaggttcctgccctgctgtagtccccaggccagtgcttggcaggtgctcagggaatgtatccaccaaccaaggtttggggtggctgtctctgcctgaccactttccccaggcccctggcgggtacctgagctgtgctctcagggcctcaggaacctccttccatattcagggcctgtgcctggggaggcttcagggtgtagcagctgtgcccatcccaggctgacccacccagcttgcctggtagcccagcctctgggctagtgtgccgtggggcaggggatgtgctgtagcctggtgcagagtccccaaccccagaagggggccatggaagctgacaccccaagtggccgcccccctgctctgtcttgcttcggacactgtggccgggtccaggatcctggcatcctgggaggtctctggctttgtgggcagcctgcctggcccgcacagtctgcctgtcctgagggtgagacacaggtcaagcccacagacccccttgctcccctgctggggcctccaggctcacagaccaccccaccctaccctgtccttgcccaagcaaatgagaggcaggggcttcccgggctgctgctgtcccgccctctgtggggcaggaggaggtgcccacagaggctgggtggtgatagccaggagatgggctggcatctgcattacccaagctctgctgcccatggtggcctttctgggggtgggtgctggtccctgccccctgccccacccctgatgtctgctccagagacaaaggtggggagggtgctgaagaggaagtgtttgcccagggagaggctgcggctcctcctgaaacatcagccctgtgggtcctgtttgcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 1619 - DNA, 2544 bp, Homo sapiens
agatccagtaaggaacagacagtcagtatttaggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaagccggcagggatttagcacaagatacaagatatacaggagaggagtcactcacaatttttgtggacaagcggaagttgagcaaacgagctgaaggaagtgattccaccaccaatagctcttcggtcactctggagacgctacatcagctagccgcttcttatttcattgacagggacagcacccttcggagacttcaccacattcaaattgcatccactgccataaaggtaacagaaacacggactggtcctcttggctgcagtaactatgacaacctagattctgtcagttctgttctggttcagagtcctgagaataagattcagttgcaagggcttcaagtacttctcccagactatcttcaggaacgttttgtacaagcagctttgagctacattgcttgcaattcagagggagagtttatctgcaaggaaaatgactgctggtgtcactgtggtcccaaatttccagaatgcaactgcccctccatggacattcaagccatggaagagaatcttcttcgaataactgaaacctggaaagcttacaacagtgactttgaggaatcagatgaattcaagttatttatgaaaaggctacctatgaattatttcctcaacacatctactataatgcatttgtggacaatggattctaattttcagcgccgttatgaacaactggagaacagcatgaaacaacttttcctaaaggcgcagaaaattgtacacaagctttttagccttagcaagaggtgtcataaacaacccctcatcagcctgccaagacaaagaacctcaacctactggcttactcgcatccagtcttttctctactgcaatgagaacggcctcctaggcagcttttcagaagagacgcactcgtgcacgtgtccgaatgaccaggtggtctgcaccgcgttcctgccctgcacagtgggagacgcctctgcctgcctgacatgcgcaccagacaaccgcacccgctgcggcacctgcaacaccggctacatgctcagccaggggctctgcaagcctgaagtcgccgagtccaccgatcactatattggctttgaaactgacctgcaagatctcgagatgaaatatctgctgcagaaaacggacagacgaatagaagtccatgccatttttatcagcaatgacatgcgcctcaatagctggtttgatccctcctggcgtaagcggatgctcctcaccttgaagagcaataagtacaagtcaagtctggtccatatgattttgggtctctctttacagatttgcttaactaaaaacagcaccttggagccagtgttggctgtttatgtcaatcccttcggaggcagccactctgagagctggtttatgcctgtgaatgaaaacagctttccagactgggagcggactaagttggacctacccctgcagtgttataactggacattaactctggggaacaaatggaagacattttttgagacagtacacatctacctgagaagtcgcatcaagtccaatggtcccaatggtaatgagagcatttactatgaacctctggagtttattgacccttcccggaacctgggctatatgaaaatcaataacattcaagtgtttggctacagcatgcactttgaccctgaagcaattcgggacctgattttgcagctggactacccctatactcagggatcccaggattcagcacttttgcaactactagagatcagagaccgtgtaaataaactctccccacctggtcagcgtcgtctagatcttttctcttgcttgcttcgtcatagactcaagctgtctactagtgaggtggtgaggatccaatctgctctgcaggcgtttaatgccaaattgccaaacacaatggattatgacacgaccaaattatgtagttaaccataaatgtcaagcacaacccaaaatcttgaaggagtttttacagtgcttttgtggaacagtttatgtttggaagagtaaatttaaattgtcttttcaatatctgtcttatatcagtcaataacattggatggcaatttacacacatgaacttgctgacaatgaatatattatacagcagttttggtttatgaatgacataaatactgacaccagtctagaagacattctactttttacaataaatttcatttgtaattttatatgttccgtggcaatgcttttgtgcattacatcctctagagggaacataaaaagataccaataaaattttgtagctgaacagttatt

SEQ ID NO: 1620 - DNA, 939 bp, Homo sapiens
agttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccacgtattatcgggggacccacggggtcattgtggtttacgacgtcaccagtgccgagtcctttgtcaacgtcaagcggtggcttcacgaaatcaaccagaactgtgatgatgtgtgccgaatattagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgcc

SEQ ID NO: 1621 - DNA, 1487 bp, Homo sapiens
aacacatcagcttcaaaggcagagagaatcgaaggtgctctccagctttggacacttcctctgcttgaggacaccttgactaacctccaagggcaactaaaggatcaagaaaggcccagcacagcagaagatcagctggatctagctcctgcaggagatgtgtacaaagacaatcccagtcctctggggatgtttcctcctgtggaatctctatgtctcatcctctcagaccatttaccctggaatcaaggtgttcaagctggaatgaagatgattgagcaaatgctaaaagaaaagaaactcccagatttaagcggttctgagtctcttgaatttctaaaagttgattatgtaaactacaatttttcaaatataaaaatcagtgccttttcatttccaaatacctcattggcttttgtgcctggagtgggaatcaaagcgctaaccaaccatggcactgccaacatcagcacagactgggggttcgagtctccacttttctctgtcccattattgcaagtgaagtcaaagcgctaaatgccaacctcagcacactggaggttttaaccaagattgacaactacactctgctggattactccctaatcagttctccagaaattactgagaactaccttgacctgaacttgaagggtgtattctacccactggaaaacctcaccgacccccccttctcaccagttccttttgtgctcccagaacgcagcaactccatgctctacattggaatcgccgagtatttctttaaatctgcgtcctttgctcatttcacagctggggttttcaatgtcactctctccaccgaagagatttccaaccattttgttcaaaactctcaaggccttggcaacgtgctctcccggattgcagagatctacatcttgtcccagcccttcatggtgaggatcatggccacagagcctcccataatcaatctacaaccaggcaatttcaccctggacatccctgcctccatcatgatgctcacccaacccaagaactccacagttgaaaccatcgtttccatggacttcgttgctagtaccagtgttggcctggttattttgggacaaagactggtctgctccttgtctctgaacagattccgccttgctttgccagagtccaatcgcagcaacattgaggtcttgaggtttgaaaatattctatcgtccattcttcactttggagtcctcccactggccaatgcaaaattgcagcaaggatttcctctgtccaatccacacaaattcttattcgtcaattcagatattgaagttcttgagggtttccttttgatttccaccgacctgaagtatgaaacatcctcaaagcagcagccaagtttccacgtatgggaaggtctgaacctgataagcagacagtggagggggaagtcagccccttgattgccggtttgcaattcaccccaggaagtaaatggtccttaatcctacaactactgt

SEQ ID NO: 1622 - DNA, 2906 bp, Homo sapiens
agagaacacgcgatgaccacgtggagcctccggcggaggccggcccgcacgctgggactcctgctgctggtcgtcttgggcttcctggtgctccgcaggctggactggagcaccctggtccctctgcggctccgccatcgacagctggggctgcaggccaagggctggaacttcatgctggaggattccaccttctggatcttcgggggctccatccactatttccgtgtgcccagggagtactggagggaccgcctgctgaagatgaaggcctgtggcttgaacaccctcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttggccaccatcaacttgcagtcaacacacgagctgcagctactgaccacctttctcttcaacgtccaggggactcagcccaagatggtgatggagtactggacggggtggtttgactcgtggggaggccctcacaatatcttggattcttctgaggttttgaaaaccgtgtctgccattgtggacgccggctcctccatcaacctctacatgttccacggaggcaccaactttggcttcatgaatggagccatgcacttccatgactacaagtcagatgtcaccagctatgactatgatgctgtgctgacagaagccggcgattacacggccaagtacatgaagcttcgagacttcttcggctccatctcaggcatccctctccctcccccacctgaccttcttcccaagatgccgtatgagcccttaacgccagtcttgtacctgtctctgtgggacgccctcaagtacctgggggagccaatcaagtctgaaaagcccatcaacatggagaacctgccagtcaatgggggaaatggacagtccttcgggtacattctctatgagaccagcatcacctcgtctggcatcctcagtggccacgtgcatgatcgggggcaggtgtttgtgaacacagtatccataggattcttggactacaagacaacgaagattgctgtccccctgatccagggttacaccgtgctgaggatcttggtggagaatcgtgggcgagtcaactatggggagaatattgatgaccagcgcaaaggcttaattggaaatctctatctgaatgattcacccctgaaaaacttcagaatctatagcctggatatgaagaagagcttctttcagaggttcggcctggacaaatggagttccctcccagaaacacccacattacctgctttcttcttgggtagcttgtccatcagctccaccccttgtgacacctttctgaagctggagggctgggagaagggggttgtattcatcaatggccagaaccttggacgttactggaacattggaccccagaagacgctttacctcccaggtccctggttgagcagcggaatcaaccaggtcatcgtttttgaggagacgatggcgggccctgcattacagttcacggaaaccccccacctgggcaggaaccagtacattaagtgagcggtggcaccccctcctgctggtgccagtgggagactgccgcctcctcttgacctgaagcctggtggctgctgccccacccctcactgcaaaagcatctccttaagtagcaacctcagggactgggggctacagtctgcccctgtctcagctcaaaaccctaagcctgcagggaaaggtgggatggctctgggcctggctttgttgatgatggctttcctacagccctcagaaaaagtgctgaaacgtgcccttgcactggacgtcacagccctgcgagcatctgctggactcaggcgtgctctttgctggttcctgggaggcttggccacatccctcatggccccattttatccccgaaatcctgggtgtgtcaccagtgtagagggtggggaaggggtgtctcacctgagctgactttgttcttccttcacaaccttctgagccttctttgggattctggaaggaactcggcgtgagaaacatgtgacttcccctttcccttcccactcgctgcttcccacagggtgacaggctgggctggagaaacagaaatcctcaccctgcgtcttcccaagttagcaggtgtctctggtgttcagtgaggaggacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcagtggcccccgccccccaccccccacgcccgaacagcaggggcagagcagccctccttcgaagtgtgtccaagtccgcatttgagccttgttctggggcccagcccaacacctggcttgggctcactgtcctgagttgcagtaaagctataaccttgaatcac

SEQ ID NO: 1623 - DNA, 1598 bp, Homo sapiens
tttgtatgggctgcagcctgccgctgagctgcatcatggtgcggtctgtggcctgggcaggtttcatggtcctgctgatgatcccatggggctctgctgcaaaactggtctgctacttcaccaactgggcccagtacagacagggggaggctcgcttcctgcccaaggacttggaccccagcctttgcacccacctcatctacgccttcgctggcatgaccaaccaccagctgagcaccactgagtggaatgacgagactctctaccaggagttcaatggcctgaagaagatgttcacagatatggtagccacggccaacaaccgtcagacctttgtcaactcggccatcaggtttctgcgcaaatacagctttgacggccttgaccttgactgggagtacccaggaagccaggggagccctgccgtagacaaggagcgcttcacaaccctggtacaggacttggccaatgccttccagcaggaagcccagacctcagggaaggaacgccttcttctgagtgcagcggttccagctgggcagacctatgtggatgctggatacgaggtggacaaaatcgcccagaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgagtcttccatacttgccttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcagcggggcggctgttccagcaaagctgcccgacaggcctggtgttcagcaactcctgcaaatgctgcacctggaattgagtcgctaaagcccctccagtcccagctttgaggctgggcccaggatcactctacagcctgcctcctgggttttccctgggggccgcaatctggctcctgcaggcctttctgtggtcttcctttatccaggctttctgctctcagccttgccttccttttttctgggtctcctgggctgcccctttcacttgcaaaataaatctttggtttgtgcccctc

SEQ ID NO: 1624 - DNA, 1472 bp, Homo sapiens
ctcactgcggaccctggattgaaacgatctccccgcggccgccgccgctacctggtgcccgcaggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgaggtggcggggccgcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttatatcatgaagttcccgctaaaccggcaggcgatgagaaaggaaaccatcactaagatgctctggagtacccgcaccctgttgaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtggga

SEQ ID NO: 1625 - DNA, 561 bp, Homo sapiens
taaagttattcaatctcctgagcctaacagcaatgtagaaacggaactttttgcttttccaaaaggccataagatgttttattgaaagaaactttcaatatcaagtaatccaaccaaccttctaagataagccttttccttcaacacaaagaagtgcattttgccaaatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtga

SEQ ID NO: 1626 - DNA, 432 bp, Homo sapiens
gccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatccca

SEQ ID NO: 1627 - DNA, 2028 bp, Homo sapiens
cacctttgggcccagggtgaccggatcctgggtcccaaggagagaagccccaggtccccgacccttcctgctcttcctgcccggccttggaagccaggcccatctctctggggtccgtctgtcgcgtggcagagaggctgggtgtggatggtgacccagagcaccggggtgggggtgagtgtccgaggagtacccaggtccagaggcccctcttgcggggaaggtgacccatagcccctggcgcgggcaggcagctggcacaggataaggccagaggggcagcagggagaaccggccgggcgagttgtcagcagaatccagggctgggccctgggcaccactggctccaggctttcccgaggccccaggcggggtagcctcacctgggggccacctgactctgctagaggaccccagggtgctgccccatgccaggccccagggacatgagccaggatctggagccggaagcctcagctagctgcagcccctacctctgggtagggtctctgagggagggcctcctccttcctcctgtcctccaaccagactcggcccatgtccaaggaatctgtccaggccagcaaaggtggggatggggccagccccaagggatggatgaggcactcatggaagcagatggcacagtgaggcagcaatggctgcactgagccgggcactgggtccactcagaaccccagctcctcctctgtggattgggctcttcctagtagccacaggaagtcaacaaagcctggcccagcccttgccaggaaacaccacagaggccacaccacgaagtctgagggcctccgggtccttgtgtggaccccatgctaaagcaccatacctgtgcgaggccacccatgaacctgctgcagccaggattcgtgcccaagtccccgacacgcgctggagcagggttgggggtcagcggttctacagccgtgtcctgagccccctgcaccgtggaccctcagggcacactgaggcctctgctcagaggtcccacatggggaagctgaaggagccgcagcctcaggaccacaagccagggttaggtgcttcctaacctctgtgcttcagagagggccgggagtggtggctcatgcctgtaatcccagcacattgggaggctgaggagggaggattgcttgagcccaggagttcgagaccagccagaaaaacaaggtgaaaccacgtctctgcaaaaaatacaaaaattagccaggtgtggtggtgcacgcctgtggtctcagctactctggaggctgaggcagaaggattgcttgagcccaggaggtcgaggctgcagtgagctatgattacaccactgcactccagcctgggcgatagagtgagaccctgtctcaaaaataaaaatacaaaaatataattcacataccatacaatttcccttcaaggccaggcgcggtggctcatgcctgaaatcccagcactttgggaggccaagaagggaggatcacttaagcccaggagttcaagaccagccagaaaaacaaggtgaagccacgtctatgcaagaaatacaaaaattagccgagtgtgatggtgcacacctgtggtcccagctactctggaggctgaggtggaagtattgcttgagcccaggaggtcgaggctgccgtgagctatgattgcaccactgcactccagcctgggtgacagagtgagaccctttctcagaaatgaaaataaatgtaattcacacaccatataattgctcttcaaagccaggtgcggcagctcatgcctgtaatgctcccagcattttgggaggccaaggcaggtggatcacgaggtcaagagattgagaccatcctggccaacatggtgactagtaaaaatacaaaaattagctgggcgtggtggtgcacgcctatagtcccagctactcaggaagctgtagcaggagaatcacttaaacctggggggaggtgaaggttgcagtaagccgagatggtgccactgcactccagcctgggcaacagggcaagactccatgtc

SEQ ID NO: 1628 - DNA, 574 bp, Homo sapiens
ctaatttacattttcatcaacagtgtacgagggttctccgttttctgcactcttgccagcatccgttttttcctgtctttttgataaaaaccactttaactgggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacatatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggt

SEQ ID NO: 1629 - DNA, 1891 bp, Homo sapiens
agtttcaccagaaaccagggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttacggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacgcggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagc

SEQ ID NO: 1630 - DNA, 911 bp, Homo sapiens
gtcacgtggggctgcgcccaaggctgccgggagcagactgggctgcgggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcaggctacgtttgcgagaggaaggatttgctggtaaatggctgctgtaatgtcaacgtccctagcacgaagcagtactgctgtgatggctgctggcccaacggctgctgcagcgcctatgagtactgtgtctcctgctgcctgcagcccaacaagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttg

SEQ ID NO: 1631 - DNA, 2077 bp, Homo sapiens
agcccagcgctcctccccgcaaatgatcccgccccaggggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatggtgaccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctg

SEQ ID NO: 1632 - DNA, 3301 bp, Homo sapiens
attgttatcttaagacactcatctggtgtctgagtctgcaggtgacactgcttaggtacggagcgcggagtcggagcggggacgcgccgggctgcagctctgggatgcaatccgcctgcctcgcaagctgctcgccgctgcgctggcagcgcttacgctgagctcggaggatcccattaggacttgcccggggatgtgcacctgccgtgcgctccgaggtcagtggcaggtctgcaggcagccgagggagcggtgaagccggaagacctgtctctgcccatgtgcaaggcagtgatttcggctccgagccctggaggagcagcacggagcgggagagcgtggcgagagaatgaagaaaccaatcgcccgggagaagcatgaggtggcagtgtggcactcggtttagagggcttcggccggcggtggccccatggacagccctgctggcactgggcctgcctggctgggtgttggctgtctcagccacggcggctgctgtggtccccgagcagcatgcctccgtagctggccagcatcccctggactggctgctcacagaccggggccccttccaccgcgctcaggagtatgctgacttcatggagcggtaccgccagggtttcaccaccaggtacaggatttataggcttttcccccagggagtttgcccgttggaaggtgaacaacttggctctggaaaggaaggacttcttcagtttgccattgcctcttgccccagagtttatccggaacattcgcctccttggaaggagacccaatctgcaacaggttacagaaaatctgattaaaaagtacggcactcatttcttactttctgccacccttggaggagaagagtccctgaccatttttgtggacaagcagaaactgggaagaaagacagagacaacaggaggtgcctctataatcgggggcagtgggaacagcacagctgtgtccctggagaccctgcaccagctggccgcctcctacttcatcgacagagagagcacgctgcgacggctgcaccatatccagatagccacgggggccatcaaggtcaccgagaccaggaccggtcctctgggctgcagcaactatgacaatctggactcagtcagttctgtcttggtacagagtccagagaacaaagtacagttacttggtctcacagtgtcgctactggggagcctcctgcagatctgacctcgaacgtggcccagactgcatccaaaggcatgcctaccctttgttcatcctttggccttcaggtgctgctgcctgagtatctgcgtgagcgctttgtagctgcagcactcagctacatcacatgcagctctgagggtgagctcgtctgcaaggagaatgactgctggtgcaagtgcagccccaccttccctgaatgcaactgccctgatgctgacatccaggccatggaggacagcctgctgcagatccaggactcctgggccactcacaaccggcagtttgaagagtcagaagagttccaggccctgctgaaaaggctgcccgatgaccggttcctgaactccacagctatctcccagttctgggccatggacaccagccttcagcaccgctaccagcagctgggagctggcttgaaagtgctgttcaaaaagacccatcggatcctacgccggctcttcaacctctgcaagcgctgccatcgccagcctcgcttccgcctgcccaaggagagctccccaaggtccttgtcctactggtggaaccgaatccagtccctcctctactgtggggaaagcacctttcctggcactttcctggaacagagccacagctgcacctgcccctatgaccaatcttcctgccagggccccatcccatgtgccttgggcgaagggcccgcgtgtgcccactgtgctccagacaatagcacacgctgtgggagctgcaacccgggctatgtgctggcccaggggctgtgccggccagaggtggccgagtccctggaaaactttcttgggctggagacagacttgcaggacctggagctaaagtacctgctgcagaagcaggatagccgcattgaggtacactccatcttcatcagcaatgacatgcggctgggcagctggtttgacccttcctggaggaagcgcatgctgctcaccctgaagagcaacaagtacaagcctgggctggtgcacgtgatgttggccttgtccttgcagatctgtctcaccaagaacagcaccctggagcctgtcatggccatctacgtcaacccctttgggggcagccactctgagagctggttcatgcctgtgaatgagggcagctttcctgactgggaaaggactaacgtggatgcagctgcccagtgccaaaactggactatcaccttggggaataggtggaagactttctttgagacagttcatgtttacctacggagccgaatcaagtccctggatgacagctccaatgagacaatctactatgagcccctggagatgactgatccctctaagaatttgggttacatgaaaattaacaccttgcaggtctttggctacagcctgccctttgacccagatgctatccgggacttaattctccagttggactacccatatactcaaggttcccaggactctgcactcttgcagctcattgagctcagggaccgggtgaaccagctttctccacctggcaaagtccgacttgaccttttctcctgcttgctccggcatcggcttaagctggccaacaatgaggtgggcaggatccagtcctccctgagggctttcaattctaagctgccaaaccctgtggaatatgagaccggcaaactctgtagctaatgggcggcccacttcagcactgggcaaggaggggatccatgaatctggggtacaaagataatctaagccctcaccttagtgccaacagggtgtgctcccacgagactttcagcatccagtagatgggacctcgaggctcgagctgaagcaggcgagagagaaacagctactgcgtgcgtgcgcgcacgcatacacacacacacacacacactggcacagggaggctacaactaagcagcctcagatctgtaaagttgattggtgctttctaaaatgaatgcaattgaaagaaaggagccaaggaagagattaagaaaaagaaccagctgaaccatgaaacaaacaaaaatcctaaaagtgattcttgtcattcaagaaagcaagaggggacaacaatgggaggggtcggagctcttccttcccctctgtggagtcacttttgtattcttttt

SEQ ID NO: 1633 - DNA, 2801 bp, Homo sapiens
tcagactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaattgatttaaaaaagagaaaagaagaagaaaaaaggcaacagaaaggagaagcataagcaatagtattttgggaagctataacacgcgacttgcctccctgttcacctttgtattctcagcacctagaatagttctggtacaaaataagttcacagtaaatggttgtcaaatgaataaattaattattatatctttaaatagtaactattgtttttaccctctaacatatttcagagaaatgcttagtgctacaagaaagtaaagtttgctttctaaggtatgattgactggagtaagaatcaattttcctcacaaaaccaggtacaaaataaaagagtcaactagccaaaagaccactttaccatggtcacccaatgtttagtttaagagccagaagcttttaacctccggtacaaattctgtcctaagttttggccgaaacaacctaagactcagcagtatccctttgccatagagatgcaaggctggattagattcaagcaccatcgaagccaaagacaccccaagccagtgatgtgctgtgggttgtttggaaatgtcgattagataaggctcatggtatgattcagagctccaaggacagttcttgttcaggtttcaactaatcaacatcggattatgcacacctcaacatctgaaatatgcagacatttgagacaaataccagaattgtgtcttcttgctttgtacaaatcatgcttcagtctggcaataagcatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaa

SEQ ID NO: 1634 - DNA, 2235 bp, Homo sapiens
cagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacagttcatcattcccctgcatattcttttcctgctgctatccagagaaatcagcctcagcgccctgaaagcttccttttccgagcaggtgtcagggcagaaaccaacaaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagat

SEQ ID NO: 1635 - DNA, 2604 bp, Homo sapiens
atcgccccctttcccctcccatctcccggccgtggtgcggcgcagctctctccccctccgcagtctcagtggcgagctctgggtgctgtggcccggccttggcggggcggcctccggctcaggctggctgagaggctcccagctgcagcgtccccgcccgcctcctcgggagctctgatctcagctgacagtgccctcggggaccaaacaagcctggcagggtctcactttgttgcccaggctggagttcagtgccatgatcatggtttactgcagccttgacctcctgggttcaagcgatcctgctgagtagctgggactacaggacaaaattagaagatcaaaatggaaaatatgctgctttggttgatatttttcacccctgggtggaccctcattgatggatctgaaatggaatgggattttatgtggcacttgagaaaggtaccccggattgtcagtgaaaggactttccatctcaccagccccgcatttgaggcagatgctaagatgatggtaaatacagtgtgtggcatcgaatgccagaaagaactcccaactcccagcctttctgaattggaggattatctttcctatgagactgtctttgagaatggcacccgaaccttaaccagggtgaaagttcaagatttggttcttgagccgactcaaaatatcaccacaaagggagtatctgttaggagaaagagacaggtgtatggcaccgacagcaggttcagcatcttggacaaaaggttcttaaccaatttccctttcagcacagctgtgaagctttccacgggctgtagtggcattctcatttcccctcagcatgttctaactgctgcccactgtgttcatgatggaaaggactatgtcaaagggagtaaaaagctaagggtagggttgttgaagatgaggaataaaagtggaggcaagaaacgtcgaggttctaagaggagcaggagagaagctagtggtggtgaccaaagagagggtaccagagagcatctgcgggagagagcgaagggtgggagaagaagaaaaaaatctggccggggtcagaggattgccgaagggaggccttcctttcagtggacccgggtcaagaatacccacattccgaagggctgggcacgaggaggcatgggggacgctaccttggactatgactatgctcttctggagctgaagcgtgctcacaaaaagaaatacatggaacttggaatcagcccaacgatcaagaaaatgcctggtggaatgatccacttctcaggatttgataacgatagggctgatcagttggtctatcggttttgcagtgtgtccgacgaatccaatgatctcctttaccaatactgcgatgctgagtcgggctccaccggttcgggggtctatctgcgtctgaaagatccagacaaaaagaattggaagcgcaaaatcattgcggtctactcagggcaccagtgggtggatgtccacggggttcagaaggactacaacgttgctgttcgcatcactcccctaaaatacgcccagatttgcctctggattcacgggaacgatgccaattgtgcttacggctaacagagacctgaaacagggcggtgtatcatctaaatcacagagaaaaccagctctgcttaccgtagtgagatcacttcataggttatgcctggacttgaactctgtcaatagcatttcaacatttttcaaaatcaggagattttcgtccatttaaaaaatgtataggtgcagatattgaaactaggtgggcacttcaatgccaagtatatactcttctttacatggtgatgagtttcatttgtagaaaaattttgttgccttcttaaaaattagacacactttaaaccttcaaacaggtattataaataacatgtgactccttaatggacttattctcagggtcctactctaagaagaatctaataggatgctggttgtgtattaaatgtgaaattgcatagataaaggtagatggtaaagcaattagtatcagaatagagacagaaagttacaacacagtttgtactactctgagatggatccattcagctcatgccctcaatgtttatattgtgttatctgttgggtctgggacatttagtttagtttttttgaagaattacaaatcagaagaaaaagcaagcattataaacaaaactaataactgttttactgctttaagaaataacaattacaatgtgtattatttaaaaatgggagaaatagtttgttctatgaaataaacctagtttagaaatagggaagctgagacattttaagatctcaagtttttatttaactaatactcaaaatatggacttttcatgtatgcatagggaagacacttcacaaattatgaatgatcatgtgttgaaagccacattattttatgctatacattctatgtatgaggtgctacatttttaggacaaagaattctgtaatctttttcaagaaagagtctttttctccttgacaaaatccagcttttgtatgaggactatagggtgaattctctgattagtaattttagatatgtcctttcctaaaaatgaataaaatttatgaatatgactt

SEQ ID NO: 1636 - DNA, 2541 bp, Homo sapiens
atgtttaagtgctggtcagttgtcttggttctcggattcatttttctggagtcggaaggaaggccaaccaaagaaggaggatatggccttaaatcctatcagcctctaatgagattgcgacataaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagaccctagctaacatattatggagagaagaaggtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaa

SEQ ID NO: 1637 - DNA, 718 bp, Homo sapiens
gagctgaggagggggcttcggagcgggactgggacggcggcgcgatgctgggcgtcctggagctgctgctgctgggggctgcgtggctggcgggcccggcccgcgggcagaatgagacggagcccatcgtgctggagggcaagtgcctggtggtgtgcgactccaaccccacgtccgaccccacgggcactgccctgggcatctctgtgcgctctggcagcgccaaggtggctttctctgccatcaggagcaccaaccacgagccgtccgagatgagtaatcgcaccatgatcatctacttcgaccaggtactagtgaacattgggaacaactttgattcagaacgcagcactttcatcgccccgcgcaaagggatctacagttttaacttccacgtggtaaaagtctacaacagacaaaccatacaggtgagcctcatgctaaacgggtggccggtgatttcagccttcgctggtgaccaggacgtgacccgggaggccgccagcaacggagtcctaatccaaatggagaaaggcgaccgagcatacctcaagctggagcggggaaacttgatggggggctggaagtactcgaccttctccggattcctggtgtttcctctctgactggctcgtagccggaagggaggcagggagagggcgaaggcaggaaggggagtgagaaagaggctgaaattaagagggcgagaaagcagcac

SEQ ID NO: 1638 - DNA, 3531 bp, Homo sapiens
agtggagatggagtttcaccatgttggccaggctggtctcaaactcctgacctcaggtgatccacctgcctcggcctcccaaagtgctgggattacagctatgcctggctaatttttttttttttttacttttttatttttatttttttgaaacggagtttcactcttgtcacccaggctggagtgcagtggcgcgatctcggctcactaaaccccatctctactaaaaatacaaaaatttgccgggcatggtagcagctatggtgggcagcatggtgggcaagtagtcccagctacttgggaggctgaggcaggagaatcacttgaacccaggaggcagaggttgcagtgagccaagatcatgccactgcactccagcctgggtgacagagcgagactccatctcaaaaaaaaaaaaaaagtttattggtaagaattttattctttttattctttttcattgcttttataaatgaaattgttttcttaatttcctttttggatttttcattattagtgtatagaaacaactaatttctatgtgttaattttgtatcctgcaactttgctgactttattaattctaataagtgtgtgtgtgtgtgtatgtgtgtgtaatccatcttggttttgtttttatttttacttggagactcaggcagggacaggttttcttgtcatcttccaaagcctgtgggtagactttttctaggtccctattcattgaagaagcaggcttcaaggatcccagctgtcctcaagagtactggttccagcttcctgcttcatgaaccggtcatggcccctgcaaggtcaaggtcattataatgccagcacctgactgctaaggctatttcccttccaataccttcccctcagagctcctggtgcatcagctcattcaaccttctgcttttctgctctctcttgatttaagaaacagacacattatatttctacatagttagagcacaggggtcccagcatcccacttccaaatgagcatgtcaagcacatgcattcagagaggatacctggaagccaaaattttgccatagtgaaaggccttattcctgaatacagctagagtggggaagaccttggcctctccccccgcaggcaagaatgttgcctccacagggggctggtagcctgctaaggcccaggccacatgagtgggttgtctactgttactgagggcctactatgtgccagacaccatactaggtgctttacatacattatatgtcattgaatcttccctctagtcctgtgagataggtactattattgtcactgattcacttgagaaagctgccaaaacacagatagcaaggggcagaaccaggattctgatttaggttggctcagccttttatcaaatacatctggtcttcctctgtcctttcaaaagcctatagcttcctcatcttgcccactcctctgtgggtagggtctgtggtttcctttctcttatctatcttcaacacacagtgggtgtgacctgggtgcaaccagtcacagctctgcagaggttactgtgattttgcccctgaaggatctgtccacaacttaggaactcacacagcttttggcctgagcccccgttaccaagagaaaggaggtttttgccaaggactccaaggggagtgcacttgatgctggtcgggacccaaagcgcccagccctccctgagacattgtgtgagtcgggctgggcctcaaacacggcccccactgccccaccccagccagggtggtgcttgtgtgggaaggactttaaatccagctgccagacccctggacgggagaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtgcagagggccctgacaagcctagcgtcgtgtcagggctgaactcgggccctggtcatgtgtggggccctctcctgggactactgctcctgcctcctctggtgttggctggaatcttctgaaggggataccactcaaaggcaaggcctggtgaggggggccctggcctcatacccacctggattgtcttcctccaagtgagagaccacagcttcctgggcaggtcctgctctgtggcccagcagccccccttcaccccaacttctggccagattccaggccagcactcttgtcctcctgggaggcgtctacagggccagcccctggcactgccccaggagtgccttggctctgggtaggcccatccttcagctggctgcagactgttctgagcggtatttacatgtgcccactctcaggttgtcctgtggccatcagcttctctcccagacagaggatctcaggcttcccaggaacccccgggcccctcccagtcccctggcctcttccttgagccatctgagtccaggactgttccccagaagtgcctcttgccttctcagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacctg

SEQ ID NO: 1639 - DNA, 1318 bp, Homo sapiens
gatgcggccggggctgcgcggtggtgatgcgagcctgcagggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatggaccaagttttcatgattgactccaagtgtgaatctggaaaaggacgctgctctttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaactaatacttgtgtctgaagataacagtaattttttattcttgtgtcccctactgggcacatcaaagtgctttttggataaaatatgctcaagtaatggatacgtatattaacatataagtatattctgaaaactgacct

SEQ ID NO: 1640 - DNA, 1863 bp, Homo sapiens
ctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggctggtgtggctgagtgctgccatggggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctg

SEQ ID NO: 1641 - DNA, 3267 bp, Homo sapiens
acctgacatgagggcggggaccccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtgatttcatgatcctttggctgcatggagaaaatgggacagggcctgctaagttcaacatacctcacagtgttacatgattcagctggtcgggtgtgggttgctgaccgaggaaataaaagaatccaagtatttgataaagacactggggagtggttaggagcatggaataattgtttcacagaagagggaccttcttcagtcaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcctgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcactttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacagacttgccctttgaaatctatacctctggatacattagaggcattttattaacaaaggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtc

SEQ ID NO: 1642 - DNA, 1083 bp, Homo sapiens
agagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaagcacctgccaggagaacaggcagtggcagtgtgaccaagaaccatgcctggtggatccagacatgatcaaagccatcaaccagggcaactatgggtgagaggccctagaggcaccctcagtgggcacacatgcatactcatgcatgtatacacgcatgctgtgctgtggggcacgtccagcaggccactcctacacccagatttgactgtgtgtgcgctcagccactgtgcgtctctcccacccacatgcacccacgccaaggaccctgagcctcggcagatctgtgacttccttccgtcccctctccttcagctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccga

SEQ ID NO: 1643 - DNA, 1539 bp, Homo sapiens
gtgtgcacactcagctacgggacacatttcaggtatccaaggcagcagaggtgagtgggtcccccgagctctgtgaccttatgctccacactaactctggcagagcctccgtttcctcatagaacaaagaacagccaccacccccgggagatgaagaagagagtcgaggacctccatgtaggtgccacggtggcccccagcagcaggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagc

SEQ ID NO: 1644 - DNA, 3586 bp, Homo sapiens
gcgcgtaatggcagcgccgtggcctcgcgtccatctttgccgttctctcggacctgtcacaaaggagtcgcgccgccgccgccgccccctccctccggtgggcccgggaggtagagaaagtcagtgccacagcccgaccgcgctgctctgagccctgggcacgcggaacgggagggagtctgagggttggggacgtctgtgagggaggggaacagccgctcgagcctggggcgggcggaccggactggggccggggtaggctctggaaagggcccgggagagaggtggcgttggtcagaacctgagaaacagccgagaggttttccaccgaggcccgcgcttgagggatctgaagaggttcctagaagagggtgttccctctttcgggggtcctcaccagaagaggttcttgggggtcgcccttctgaggaggctgcggctaacagggcccaggtgagaggcagctatctatctcctggggtggctcctggtaccgatggggtcctgacctactcaggggtgcccgggatagaaagggtagatgaagggacgctttaggagggttctttttgtggagtttacggtctaggtggcacggatgaggcatacctccccggggagatttagaaacgccttgggatagagagagaatggggctaggaagcaggagctagaactagcggaatgtcctactacggaagccggagctgaaaattggaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaagaaaaagaaaaaaaaaactctctaatcagttgtacacacattgaaacttatagccatggccagattttatgctaaaaatggtagtttgtcaaagacaaaattctcttagaatctaatccaacttgccagccctgagaaaatcccttttaaggccaaggaaagctgaatgctagcagccaggcctgtggtacttccatgagaaaccatagcagacaatgccctcccaagtactgaaatcacactggaatcccccttgttgggttcatttgattgtttaacacaggatgtgttgtgtcattctgaagtttttatttggggcagaagtctttatggagatgtaaatgacagcgtttctgggttatgcataacttctcactggtcagagacaccggtgtgtcaagcatggatattgcattgcaagacttgaatctataaaaattagaatcacacagtcagtactacaagcaaaacagagaacctgaaagaaggtgcacagactgtaagaaaaaacccaagtttgtgatatttcagtgattccaaagaacattctaggttttttgtttgtttttttgttttttgggttttttttttttactgcagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagtt

SEQ ID NO: 1645 - DNA, 1442 bp, Homo sapiens
ggaagcggagagcggctgatcgcagtccggaggtgaggcggaactctgaggtggtccattatggctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttg

SEQ ID NO: 1646 - DNA, 3307 bp, Homo sapiens
actgcccttacaaagctaccagcctcacggagaaggcgcagtccctgtccacagagacacagccttgccccagttactgcccacctgcaagagatccacatttctgccctccagagctcccaaactgatgggggagagagacatcatcccccagctctgggagtttccagtctgatggaggagacagagcctgcttcggtaactctcactctgcgggggaagactcagccctatccagggagctcccacactttcaatggggaggcccacccagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaacaaccagctccaggaactcccctacaatgagctgtcccgcctcagtggcctgcgaaccctcaacctccacaacaacctcatctcctccgaaggcctgcctgacgaggccttcgagtccctcacccagctgcagcacctctgcgtggctcacaacaagctctcagtggcccctcagtttctgccccggtccctccgtgtcgcggatctggctgccaaccaagtgatggagatcttccccctcacctttggggagaagccggcactcaggtccgtgtacctccacaacaaccagctgagcaacgctggcctgccccccgacgccttccgcggctccgaggccatcgccaccctcagcctctccaacaaccagctcagctacctgccgcccagcctgccgccctcactcgagcggctccacctgcagaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccgctgcggggcctgcacacgctgcacctctatggcaatgggctggaccgcgtgcctccagccctgccccgccgcctgcgtgccctggtgctgccccacaaccacgtggccgcgctgggtgcccgtgacctggtcgccacaccgggcctgacggagcttaacctggcctataaccgcctggccagcgcccgtgtgcaccaccgggccttccgccggttgcgtgccctgcgcagcctcgacctggcagggaatcagctaacccggctgcccatgggcctgcccactggcctgcgcaccctgcagctgcaacgcaaccagctgcggatgctcgagcccgagcctctggccggcctggaccaactgcgggagctcagcctggcgcacaaccggctccgggtcggcgacatcgggccaggcacctggcatgagctccaagccctccaggtcaggcacaggctggttagccacactgtccccagggcccctccatccccctgcctgccctgccacgtcccaaacattctagttagctggtaaagcaatcagaacaagaaaatgataagagtgggttagaaggtgatgaggaggctgggtgaggtggctcatgcctgtaatcccagcactttggggagccaaggcaggagaatcgctttaggctatgggtttgagaccagcctggcaacacagcaagaccctatctctaccaaaaaaacatagccaagcgtggtggcacatgcctgtagtcccagctattcaggaggctgaggcaggaggatcgcttgagcccagaagtttgaggctgcaatgagccgtgatcgggccactgccctctagactgggcaacagagcaagaccctgtctcttgaaaaaaaaagtgatgaaagaggtatggtgcgattcaatgactgactcatttaatcaagtggggacctgtctgtctgtgccttcctgggaagggccttagtttacctctgcagaagggaggaatttggcaatcatggggggtggggggcagaagggccaggctggtatgaagggggcaggggactctcagagaggttgggggctggctgagctgagtggcccaggcctggggctgccacgatgccatctataaccccctgcccagatgctggacctcagccacaatgagctgtcctttgtgcccccggacctgcctgaggccctagaggagctgcacctcgagggcaaccgcatcggccacgtgggccccgaggccttcctcagcacaccccgcctgcgtgccctcttcctcaggtgccccgagggtgaccggaggggtggaggtgggcaggggagggcctgggagggtcatgaccgcctctctgtgcagggccaacaggcttcacatgacgagcatcgcggctgaggccttcctggggctcccaaacctgcgtgtggtggacacggcagggaatccggagcaggtcctgatccggctgcctcccaccaccccacgtgggccacgggcagggggcccctgatcctagagaggcccagcagagcagctcagactcctgggactccgctgggccgtggactgaggagacaacgcccaccaggggcccttggtctggctctcctgggcctccagggctgggcctgctctgcctgccactggccgagacacagaggcacacagctggcatactccaggctcacagaccacgccggcctggcgggacacaccctaccccaaactcccaacacagatggaggcagcaacaataaagccaaacccttccagcactcagcacggaccaggcaccctttgggggctctgtccacggactcctccccacaaccagtccagctggggaaactgaggctctgggatgctaagtgggtcaggactgaattttgaggtcttgaggcacacactggggtcaccaaacagcaccctgtgcgacctagccacgtgtgattgcagggacgcccaaggccacccactgaaaaaacactgggtgacagatatagggaccctcacatgtatccccccccacagcaagcatgggaatgaaatgcatccttcaa

SEQ ID NO: 1647 - DNA, 277 bp, Homo sapiens
caccctggaaggtgcagttgggaagaaagtttctgaggctgtagacatggggatcggatgctggagaaaccccctgctgctgctgattgccctggtcctgtcagccaagctgggtcacttccaaaggtgggagggcttccagcagaagctcatgagcaagaagaacatgaattcaacactcaacttcttcattcaatcctacaacaatgccagcaacgacacctacttatatcgagtccagaggctaattcgaagtcagatgcagcaggtacattgt

SEQ ID NO: 1648 - DNA, 3040 bp, Homo sapiens
actgcccttacaaagctaccagcctcacggagaaggcgcagtccctgtccacagagacacagccttgccccagttactgcccacctgcaagagatccacatttctgccctccagagctcccaaactgatgggggagagagacatcatcccccagctctgggagtttccagtctgatggaggagacagagcctgcttcggtaactctcactctgcgggggaagactcagccctatccagggagctcccacactttcaatggggaggcccacccagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaacaaccagctccaggaactcccctacaatgagctgtcccgcctcagtggcctgcgaaccctcaacctccacaacaacctcatctcctccgaaggcctgcctgacgaggccttcgagtccctcacccagctgcagcacctctgcgtggctcacaacaagaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccgctgcggggcctgcacacgctgcacctctatggcaatgggctggaccgcgtgcctccagccctgccccgccgcctgcgtgccctggtgctgccccacaaccacgtggccgcgctgggtgcccgtgacctggtcgccacaccgggcctgacggagcttaacctggcctataaccgcctggccagcgcccgtgtgcaccaccgggccttccgccggttgcgtgccctgcgcagcctcgacctggcagggaatcagctaacccggctgcccatgggcctgcccactggcctgcgcaccctgcagctgcaacgcaaccagctgcggatgctcgagcccgagcctctggccggcctggaccaactgcgggagctcagcctggcgcacaaccggctccgggtcggcgacatcgggccaggcacctggcatgagctccaagccctccaggtcaggcacaggctggttagccacactgtccccagggcccctccatccccctgcctgccctgccacgtcccaaacattctagttagctggtaaagcaatcagaacaagaaaatgataagagtgggttagaaggtgatgaggaggctgggtgaggtggctcatgcctgtaatcccagcactttggggagccaaggcaggagaatcgctttaggctatgggtttgagaccagcctggcaacacagcaagaccctatctctaccaaaaaaacatagccaagcgtggtggcacatgcctgtagtcccagctattcaggaggctgaggcaggaggatcgcttgagcccagaagtttgaggctgcaatgagccgtgatcgggccactgccctctagactgggcaacagagcaagaccctgtctcttgaaaaaaaaagtgatgaaagaggtatggtgcgattcaatgactgactcatttaatcaagtggggacctgtctgtctgtgccttcctgggaagggccttagtttacctctgcagaagggaggaatttggcaatcatggggggtggggggcagaagggccaggctggtatgaagggggcaggggactctcagagaggttgggggctggctgagctgagtggcccaggcctggggctgccacgatgccatctataaccccctgcccagatgctggacctcagccacaatgagctgtcctttgtgcccccggacctgcctgaggccctagaggagctgcacctcgagggcaaccgcatcggccacgtgggccccgaggccttcctcagcacaccccgcctgcgtgccctcttcctcaggtgccccgagggtgaccggaggggtggaggtgggcaggggagggcctgggagggtcatgaccgcctctctgtgcagggccaacaggcttcacatgacgagcatcgcggctgaggccttcctggggctcccaaacctgcgtgtggtggacacggcagggaatccggagcaggtcctgatccggctgcctcccaccaccccacgtgggccacgggcagggggcccctgatcctagagaggcccagcagagcagctcagactcctgggactccgctgggccgtggactgaggagacaacgcccaccaggggcccttggtctggctctcctgggcctccagggctgggcctgctctgcctgccactggccgagacacagaggcacacagctggcatactccaggctcacagaccacgccggcctggcgggacacaccctaccccaaactcccaacacagatggaggcagcaacaataaagccaaacccttccagcactcagcacggaccaggcaccctttgggggctctgtccacggactcctccccacaaccagtccagctggggaaactgaggctctgggatgctaagtgggtcaggactgaattttgaggtcttgaggcacacactggggtcaccaaacagcaccctgtgcgacctagccacgtgtgattgcagggacgcccaaggccacccactgaaaaaacactgggtgacagatatagggaccctcacatgtatccccccccacagcaagcatgggaatgaaatgcatccttcaa

SEQ ID NO: 1649 - DNA, 1265 bp, Homo sapiens
agaagcaaaagagcagagctaccatgtcctcttggagcagacagcgaccaaaaagcccagggggcattcaaccccatgtttctagaactctgttcctgctgctgctgttggcagcctcagcctggggggtcaccctgagccccaaagactgccaggtgttccgctcagaccatggcagctccatctcctgtcaaccacctgccgaaatccccggctacctgccagccgacaccgtgcacctggccgtggaattcttcaacctgacccacctgccagccaacctcctccagggcgcctctaagctccaagaattgcacctctccagcaatgggctggaaagcctctcgcccgaattcctgcggccagtgccgcagctgagggtgctggatctaacccgaaacgccctggtattgaaagaaaaccagctggaggtcctggaggtctcgtggctacacggcctgaaagctctggggcatctggacctgtctgggaaccgcctccggaaactgccccccgggctgctggccaacttcaccctcctgcgcacccttgaccttggggagaaccagttggagaccttgccacctgacctcctgaggggtccgctgcaattagaacggctacatctagaaggcaacaaattgcaagtactgggaaaagatctcctcttgccgcagccggacctgcgctacctcttcctgaacggcaacaagctggccagggtggcagccggtgccttccagggcctgcggcagctggacatgctggacctctccaataactcactggccagcgtgcccgaggggctctgggcatccctagggcagccaaactgggacatgcgggatggcttcgacatctccggcaacccctggatctgtgaccagaacctgagcgacctctatcgttggcttcaggcccaaaaagacaagatgttttcccagaatgacacgcgctgtgctgggcctgaagccgtgaagggccagacgctcctggcagtggccaagtcccagtgagaccaggggcttgggttgagggtggggggtctggtagaacactgcaacccgcttaacaaataatcctgcctttggccgggtgcgggggctcacgcctgtaatcccagcactttgggaggcccaggtgggcggatcacgaggtcaggagatcgagaccatcttggctaacatggtgaaaccctgtctctactaaaaatataaaaaattagccaggcgtggtggtgggcacctgtagtcccagcaactcgg

SEQ ID NO: 1650 - DNA, 5953 bp, Homo sapiens
ctccgctcgccaccccgccgagagctggagggcgcggggccaggcgccttctgcggcaggcggacagatcctcggcgcggcagggccggggcaagctggacgcagcatgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcgacgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatgaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctagcgccgaggcagcgggcgggcgggcgggcgggcgccagggcggggccgagcgagagcgggcgccttggcccggccgccgcggacttggcccgcgagggctttcccaggtggggggagggagggggcggggccgcacggcgcggggggcgggaccctcggcggcccctccccctacccccaccctgcgcgctctgggcgggagccgcgtgcacgcggggcggggtgcgccgccggccgggccctggagaaatgacgagacgtagctacctcacggggctccttccagagcagagacgcgcttccctgggcctgggcgcggccgccgtggaggggctgggggcagcctgccctggggcccgggggcgggcgcagaatcgcacaactggggccccaggcgcggggcgtggatggcgcggagacgtggacgggaggagaactgtgaattctcaagcccgtagtgtgggcggggcgcggagcacccaccaaaccaccacccgacacgcagccgacgggatccccccctttctccccggccccttctagcagttccccgcgggccacctggctgtcacagcctggactcctccatctgaaggggcctggcagcatttggggagtggacagctcctgtccagccagcatgccccaggcggcctctgtctccactgctacctgctgagtgggtcctactgggtgggggcttggggtcggtgagtggttcacctgtggagagaggagaggaagcccctgctgctgcctgtctctgcccctgcccctgcccctgcccagcgtggggctggcccatccggaaggcagtgggcccagggacacccctgagaagcccaagccgggtggtcaccgcctcatgctggagctgcctgttggaggaggcatcgcaaacgcaaaacctcccagagagtttccttttggaaacttggaaccagccctttttatgacgttttccagggggagggggaggggcactggctgggtttacggcagtgacactatttatgtaaatgacatcagctcccgcaaggcccctcagcaatgtcaacagctggaaagggcctgaacgggcttggagtctgcaggctgcgaaggcacttgggcctggcttggggccgggggcttgtttgagctgggatggggtttgctggctcagtgaagtaccagagtgcctgagccatgggtgggcaggggcacaggaatgaccaggttcctgggggccaaggaggccatgctggcttctccaagggaaggcacagaggctgccggcctgccccctacagctgtcttgggtctggcctgggccacaccttgaccgtgcctttccagacggtctttgtggagtctgcccgtgccctccactgtgccccagccctccttccaaaatctcctagagacacggtcctcaagcaggcagccccttttgttctgacctcctcacacagggtccattcctgtgccctggggcctcctggctccctgccttcctgggctctctgcactgcccgggcctctggcccacatcctcacacccggcgcactgaattaagaggcctggctcccctcacagtcaggaaattggtttcactttcccggccagagtttggctgctcaaaagggtcataccaagtatgaagctcggcccccggtggtctggcttccctccgccttccccacatttacccgcatcacggctgccatttattgagcacctgctgtgtgccaggcactttacccacatgctcccagtgtgtactcatgacaaccctgtgggacagggactcattatcaccagcaaggagactggagtacacgtgcccaaggtcatgctgcaaattggtggcaggactggggctcaaactccagagcccgactttctgaccaggggccacgctggccctcactgcactccagctctgcagcctacccgcccaatccctgtgcaggctgggagggtgctcttgggggagtggccaccgagcccctggccctggttactgcctcttgaggacactggcatctgggctggagaacaggagcccggggtggggtagggcatggggacaatcacatcttcagaggaggcagcaaagtggtgcgggatgcagggacggacttgccagatggcagctccaggttccaggaaggcaggccttggatgctccgaagaggtggtagaaaggtgtttttagaaaggtgttttggctgcctcagggtggttggagagactccaggagagactggcagaggtgcctcaggggcagggagcagacagacctgccctgggaaggggcatttggcttccctgaatccagcccaaggctagaagacagggcccctctccaagctgtcagcgcccctcggatgcccagtgtggtgtgctgggcgccatcagcatcacaaggcactacgctgctggggcggttgtcctatttctgtctatgccagtgtggtttcttcaccctgcccagaagggctgtggcagccccacgatatcccaccctgggtctgggtctcacgggtgtcctgtgaggggcttgcatttgtggtggtctctgaggccacctcagcaacggagctggcgacacgccaagcaacaaggcatcttgcggaaaattcagccagtgtcctgcccctcccttcggctcagcaccccgcagggcacaggctgtccgcccggtggtctggcccttggggaatgcgtcagggtgaccagatccaccatgctagcagccaggtcactgttgggattgcacggtcgtcacgagctgcctttcctatccacacacccagccaggacccagcccaccactcccgactgcagccccggcctctgcggtgagcaccatccttgggaaagcacccctcctccactccggtgccccactccaaggagcagagggaaatgggaattgaggtgtcccggtttgtacagttaggaagggatgtaaaacggaactagattttgattttgaagagtgtattaaccagaattgtgctatgtaggtgtttgtttgaagaaaaacataccagattagtctttgtttttgaaacagcttccccagttgtcctttttcttaccagctgggtggtctggtgcccctgacagctgagtgcctgctttacggacacgcagtaatgccgaagatttgcgggggaggacatagggctgtccccgggattcacctgctggctgtggtctctgcccactgcttctgtccttggaaagcagggcaggaggcagcatccccaggggcctctatgtgggagggagggacacctggggtcacaacccagggagggagggtcacagcccagggaggctgggagctgctccaaggccctggaactctgcctcagtcgcggcatgctggagaggggtacggacttactttcttggagttgtcccaggttggaatgagactgaactcaagaagagaccctaagggactggggaatggttcctgccttcaggaaagtgaaagacgcttaggctgtcaacacttaaaggaagtccccttgaagcccagagtggacagactagacccattgatggggccactggccatggtccgtggacaagacattcctgtgggccatggcacaccgggggggatcaaaatgtgtacttgtggggtctcgccccttgccaaaagccaaaccagtcccactcctgtcattggacgtttcttcccattccctcctcccaaatgcacttcccctcctccctctgccccctcctgtgttttggatttctgttcactcagaattgtaaatgtttagttgtgaccatgacgtattgtttgggtcaatgtccctttccaatgcatactaatatattatggttattatatatgaatatatttaatgacatggaaaaagttgtggattttctttctttccttttttttgggggggggtggggggttggttagagttgtaatggacccagatggaacttgtaatgtgggccccacatgatagaactaaattcagatatcattaaataaactcttgtacacta

SEQ ID NO: 1651 - DNA, 1788 bp, Homo sapiens
agaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtactccttcttccctagcaacggggattccggctttcttggtaacagaggtctcaggctccctggcaaccaaggctctgcctgctgtggaaacccaggccccaacttccttagcaacgaaagacccgccctccatggcaacagaggctccaccttgcgtaacaactgaggtcccttccattttggcagctcacagcctgccctccttggatgaggagccagttaccttccccaaatcgacccatgttcctatcccaaaatcagcagacaaagtgacagacaaaacaaaagtgccctctaggagcccagagaactctctggaccccaagatgtccctgacaggggcaagggaactcctaccccatgcccaggaggaggctgaggctgaggctgagttgcctccttccagtgaggtcttggcctcagtttttccagcccaggacaagccaggtgagctgcaggccacactggaccacacggggcacacctcctccaagtccctgcccaatttccccaatacctctgccaccgctaatgccacgggtgggcgtgccctggctctgcagtcgtccttgccaggtgcagagggccctgacaagcctagcgtcgtgtcagggctgaactcgggccctggtcatgtgtggggccctctcctgggactactgctcctgcctcctctggtgttggctggaatcttctgaaggggataccactcaaaggcaaggcctggtgaggggggccctggcctcatacccacctggattgtcttcctccaagtgagagaccacagcttcctgggcaggtcctgctctgtggcccagcagccccccttcaccccaacttctggccagattccaggccagcactcttgtcctcctgggaggcgtctacagggccagcccctggcactgccccaggagtgccttggctctgggtaggcccatccttcagctggctgcagactgttctgagcggtatttacatgtgcccactctcaggttgtcctgtggccatcagcttctctcccagacagaggatctcaggcttcccaggaacccccgggcccctcccagtcccctggcctcttccttgagccatctgagtccaggactgttcccca

SEQ ID NO: 1652 - DNA, 289 bp, Homo sapiens
agaaggacgcaggcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatggctgccccaggc

SEQ ID NO: 1653 - DNA, 3719 bp, Homo sapiens
ctggagggtctgctccctgtctttccaaggatgagtctccaggagatgttccgcttccctatggggctcctgcttggctctgtgctcctggtggcttcggccccagccactctggagcctcccggctgcagcaacaaggagcaacaggtcactgtcagccacacctacaagatcgatgtgcccaagtctgccttggttcaggttgacgctgaccctcagcccctcagtgacgatggggcttcgctcttggccctgggggaggccagggaggaacagaacatcatcttcaggcacaacatccgccttcagacgccacagaaggactgcgagttggcaggcagtgtccaggacctcctggcccgggtgaagaagctggaggaagagatggtggagatgaaggaacagtgtagtgcccagcgctgctgccagggagtcactgatctaagccgccactgcagcggccacgggaccttctccctggagacctgcagctgccactgcgaagagggcagggagggccccgcctgcgagcggctggcctgccccggggcgtgcagcggccacgggcgttgcgtggacgggcgctgcctgtgccatgagccctacgtgggtgccgactgcggctacccggcctgccctgagaactgcagcggacacggcgagtgcgtgcgcggcgtgtgccagtgccacgaagacttcatgtcggaggactgcagcgagaagcgctgtcccggcgactgcagcggccacggcttctgtgacacgggcgagtgctactgcgaggagggcttcacaggcctggactgtgcccaggtggtcaccccacagggcctgcagctgctcaagaacacggaggattctctgctggtgagctgggagccctccagccaggtggatcactacctcctcagctactaccccctggggaaggagctctctgggaagcagatccaagtgcccaaggagcagcacagctatgagattcttggtttgctgcctggaaccaagtacatagtcaccctgcgtaacgtcaagaatgaagtttctagcagcccacagcatctacttgccaccacagaccttgctgtgcttggcactgcctgggtgacagatgagactgagaactcccttgacgtggagtgggaaaacccctcaactgaggtggactactacaagctgcgatatggccccatgacaggacaggaggtagctgaggtcactgtgcccaagagcagtgaccccaagagccgatatgacatcactggtctgcacccggggactgagtataagatcacggtggtgcccatgagaggagagctggagggcaagccgatcctcctgaatggcaggacagaaattgacagtccaaccaatgttgtcactgatcgagtgactgaagacacagcaactgtctcctgggacccagtgcaggctgtcatagacaagtatgtagtgcgctacacttctgctgatggggacaccaaggaaatggcagtgcacaaggatgagagcagcactgtcctgacgggcctgaagccaggagaggcatacaaggtctacgtgtgggctgaaaggggcaaccaggggagcaagaaagctgacaccaatgccctcacagaaattgacagcccagcaaacctggtgactgaccgggtgactgagaataccgccaccatctcctgggacccggtacaggccaccattgacaggtatgtggtgcgctacacctctgccaaggacggagagaccagggaggttccggtggggaaggagcagagtagcactgtcctgacgggcctgaggccgggtgtggagtacacggtgcacgtgtgggcccagaagggggcccaggagagcaagaaggctgacaccaaggcccagacagacattgacagcccccaaaacctggtcactgactgggtgacagagaatacagccactgtctcctgggacccggtgcaggccaccattgacaggtatgtggtgcactacacgtctgccaacggagagaccagggaggttccagtggggaaggagcagagcagcactgtcctgacgggcctgaggccgggcatggagtacacggtgcacgtgtgggcccagaaggggaaccaggagagcaagaaggctgacaccaaggcccagacagaaattgacggccccaaaaacctagtgactgactgggtgacggagaatatggccactgtctcctgggacccggttcaggccaccattgacaagtacatggtgcgctacacctctgctgacggagagaccagggaggttccggtggggaaggagcacagcagcactgtcctgacgggcctgagaccaggcatggagtacatggtgcacgtgtgggcccagaagggggcccaggagagcaagaaggctgacaccaaggcccagacagaactcgaccctcccagaaaccttcgtccatctgctgtaacgcagtctggtggcatattgacctggacgcccccctctgctcagatccacggctacattctgacttaccagttcccagatggcacagttaaggagatgcagctgggacgggaagaccagaggtttgcgttgcaaggccttgagcaaggcgccacctaccctgtctcccttgttgcctttaagggtggtcgccggagcagaaatgtatccaccaccctctccacagttggtgcccgtttcccacacccttcggactgcagtcaggttcagcagaacagcaatgccgccagtggtctgtacaccatctacctgcatggcgatgccagccggcccctgcaggtgtactgtgacatggaaacggacggaggtggctggattgtcttccagaggcggaacactgggcagctggatttcttcaagcgatggaggagctatgtggaaggctttggggaccccatgaaggagttctggcttggacttgacaagctacacaacctcaccaccggcactccagcgcggtatgaggtgagagtggatttacagactgccaatgaatctgcctatgctatatatgatttcttccaagtggcctccagcaaggagcggtataagctgacagttgggaaatacagaggcacggcaggggatgctcttacttaccacaatggatggaagtttacaacttttgacagagacaatgatatcgcactcagcaactgtgccctgacacatcatggtggctggtggtataagaactgccacttggccaaccctaatggcagatatggggagaccaagcacagtgagggggtgaactgggagccttggaaaggacatgaattctccattccttacgtggagttgaaaatccgccctcatggctacagcagggagcctgtcctgggcagaaagaagcggacgctgagaggaaggctgcgaacgttctgatggcccgtgtgagcagtcctcgcaggagacaccaccagctgtggcagcttggggcggggtgggtagtggtcactgcggtctgggagtgctcagatagcccgcagaacaaatcatgtcaccaagcttcaagccatggaggttccttccctctcacctgcatttttgcccgtctttatgagggtcttgaaaatcaaaatagtagttgcacagtatgtgtaggaaagacagtactggaacggcaaggtttctcagcttatcttcagcaacatatatactggattagggcaagagaaggaatcacccagcacttcaccagttgg

SEQ ID NO: 1654 - DNA, 1952 bp, Homo sapiens
tctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctgaactggctcaagccagggcctctgtggaatcccaaccccgagcctggcgtccggcctgtggcgcaccctgcaagtgggctggaacatgcagcttgcccgcgggcttggcgtcctttgttgaagtggagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctg

SEQ ID NO: 1655 - DNA, 1924 bp, Homo sapiens
agcccagcgctcctccccgcaaatgatcccgccccaggggcctatcccagtccccccagtgcctttggttgctggagggaagaacacaatggatctggtgctaaaaagatgccttcttcatttggctgtgataggtgctttgctggctgtgggggctacaaaagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctg

SEQ ID NO: 1656 - DNA, 815 bp, Homo sapiens
ctcaggacagtcgctgaaatcactgaatgcctcctcaggtcatttagcacttattttatccagtatctttgggctccttctcctggttctgtttattctatttctcacgtggtgccgagttcagaaacaaaaacatctgcccctcagagtttcaaccagaaggaggggttctctcgaggagaatttattccatgagatggagacctgcctcaagagagaggacccacatgggacaagaacctcagatgacacccccaaccatggttgtgaagatgctagcgacacatcgctgttgggagttcttcctgcctctgaagccacaaaatgactttagacttccagggctcaccagaatcttgatatgtgggtgatgttaagccctcctgacccagcaagttgaaaactcaccatgaagagcagcggtcaaaggaactagggaaatcctacagtgtgatcagtttttctgctgcaggtaagcagagagcatccctttgcactgaataggccactgagccgcattactgcttattaattcctcatcattcctgcctccttttatgttctccctaaatgactaggtttgcggggccaggaactttatttcccacaatccctaacaggaagaatctgggctcgcttccaccagagagacttgttcatggaagatacggtttcgcaaggatctttgtacttgtcctgaaaactgctagcctagatattacagcatggtgccctttagcagtggtttcctgggggttttaaaacttcctgatgagggttttgtaagcataattattccctgtagtaaaccactt

SEQ ID NO: 1657 - DNA, 577 bp, Homo sapiens
acagtgggcagcccgattttctgctgagtaggcgctgtgatttcagaatgtctgggcgaggtaaaggtggcaaggggctgggtaagggaggcgccaagcgccaccggaaggtgctgcgggacaatatccaaggcattacaaagccggcgattcgccgtctcgcccgacgtgggggcgtcaagcgcatttctggtctcatctacgaggagacccggggagtcctcaaagtcttcctggagaacgtgatccgtgacgcggtgacttacacggagcacgccaagcgcaagaccgtcacggccatggatgtggtgtacgcgctgaaacgccagggtcgcaccctttatggtttcggcggttgagctgtccccacagcttctctacagactccaaaaggcccttttcagggcccccaaactgtcacagaaagagctgttaacacttcctagataacgggtaaatatcaaccctttgatgtcgccttccggataccggaaatgggatattcgcggcccgagcatctgctcgggattagacttggcgggcacggggagaactagacctcaaggagggggttccg

SEQ ID NO: 1658 - DNA, 3187 bp, Homo sapiens
atcttagttgctgccgctcccgccccgggctggcgatgctgcgccgccccgctcccgcgctggccccggccgcccggctgctgctggccgggctgctgtgcggcggcggggtctgggccgcgcgagttaacaagcacaagccctggctggagcccacctaccacggcatagtcacagagaacgacaacaccgtgctcctcgaccccccactgatcgcgctggataaagatgcgcctctgcgatttgcagagagttttgaggtgacagtcaccaaagaaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctc

SEQ ID NO: 1659 - DNA, 1967 bp, Homo sapiens
tctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaagccagggcagccctctgtggaaccccaaccccgagcctggcgtccggcctgtggcgcaccctgcaagtgggctggaacatgcagctgctacccgcgggcttggtgtcctttgtcgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagatcacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctg

SEQ ID NO: 1660 - DNA, 1560 bp, Homo sapiens
gtacctgtagctgcggcgctgaggtcggaacgtctgcgtgtgtgcgggctggttttgtggcggctgctgctagagctggagcatttgccgggttggtggctcctgcacatttttacagttctccagtccttctctttcgtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgagacattccactgcccttctcccaaaaagatgtcttttcgaaaaatggatcccagctgtacaataggattttactgtcgaaatgttcaggacttcaaacgagcttctgaagaaatcaccaagatgctgaaattttcttctaaggagaaatatcccttatttacttttgtaaatggtcattccagagactatgattttacatctactacaaccaatgaagaagaccttttttcagaggatgaaaagaaacaaaaaaaaaaaaaaaaa

SEQ ID NO: 1661 - DNA, 2199 bp, Homo sapiens
ggtttccaccctggaggttgctgacaccctgtgccctcggctgacttccagccggtggcacagacgcctccagggggcagcactcaagcgcatcttaggaatgacagagttgcgtccctctcggttgccaggctggagttcagtggcatgttcatagctcactgaagcctcaaattcctgggttcaagtgaccctcctacctcagccccatgaggacctgggactacagatggagtcttgctctcgttgcccagactggagtgcactgctgcaatctcagctcactgcaacctctacctcccaggttcaagcgattctcctgcctcagcctctcgagtggctgggactatagtaacagcgggaacatgaagccgccactcttggtgtttattgtgtgtctgctgtggttgaaagacagtcactgcgcacccacttggaaggacaaaactgctatcagtgaaaacctgaagagtttttctgaggtgggggagatagatgcagatgaagaggtgaagaaggctttgactggtattaagcaaatgaaaatcatgatggaaagaaaagagaaggaacacaccaatctaatgagcaccctgaagaaatgcagagaagaaaagcaggaggccctgaaacttctgaatgaagttcaagaacatctggaggaagaagaaaggctatgccgggagtctttggcagattcctggggtgaatgcaggtcttgcctggaaaataactgcatgagaatttatacaacctgccaacctagctggtcctctgtgaaaaataagattgaacggtttttcaggaagatatatcaatttctatttcctttccatgaagataatgaaaaagatctccccatcagtgaaaagctcattgaggaagatgcacaattgacccaaatggaggatgtgttcagccagttgactgtggatgtgaattctctctttaacaggagttttaacgtcttcagacagatgcagcaagagtttgaccagacttttcaatcacatttcatatcagatacagacctaactgagccttacttttttccagctttctctaaagagccgatgacaaaagcagatcttgagcaatgttgggacattcccaacttcttccagctgttttgtaatttcagtgtctctatttatgaaagtgtcagtgaaacaattactaagatgctgaaggcaatagaagatttaccaaaacaagacaaagctcctgaccacggaggcctgatttcaaagatgttacctgggcaggacagaggactgtgtggggaacttgaccagaatttgtcaagatgtttcaaatttcatgaaaaatgccaaaaatgtcaggctcacctatctgaagactgtcctgatgtacctgctctgcacacagaattagacgaggcgatcaggttggtcaatgtatccaatcagcagtatggccagattctccagatgacccggaagcacttggaggacaccgcctatctggtggagaagatgagagggcaatttggctgggtgtctgaactggcaaaccaggccccagaaacagagatcatctttaattcaatacaggtagttccaaggattcatgaaggaaatatttccaaacaagatgaaacaatgatgacagacttaagcattctgccttcctctaatttcacactcaagatccctcttgaagaaagtgctgagagttctaacttcattggctacgtagtggcaaaagctctacagcattttaaggaacattttaaaacctggtaagaagatctaatgcatcctatatccagtaagtagaattatctcttcatctgggacctggaaatcctgaaataaaaaaggataatgcaataaacacagttgcaggaaagtatgttagctatatactatgaagtactcttagtttacttatgttgaatggcttagctattaatactcaaattgagttaaaatgaaaattcctccttaaaaaatcaaacgtaatatgtattacatttcatggtacattagtagttctttgtatattgaataaatactaaatcacctaggtgtctatgttctatcacatctacaaacatgtcacttcctaattaacaaaatgttcttcctttagtttgcttttgcacttaaaatatatataattgacttttttggaaaaaaatctaagattcattgctttgttttgtaaagaccaata

SEQ ID NO: 1662 - DNA, 2131 bp, Homo sapiens
accaacagccgcatcgttccgaggctgtggaggccgggcgcagcggcgtcaagatggcggctgcggcagtggcggcgccagggcctcttctgcgacattaccctgtgcttcggcggggctggaggccgcgagttccgggcccaccgctcggtactggctgccgccaccgagtacttcacgcccctgctctcgggccagttttccgagtcccgctcgggacgggtggagatgcgcaagtggagctccgagccggggcccgaacccgacacagtggaagccgtaatcgagtacatgtacaccgggcgcatccgcgtcagcacgggcagcgtgcacgaggtgctggagttggccgacaggttcctactcattcgtttaaaagaattttgtggagaatttctcaagaaaaaacttcatctctcaaattgtgtggcaattcatagcttagcacacatgtacaccctgagccaacttgctctgaaggctgctgatatgatacggagaaatttccacaaagtgattcaggatgaagaattttatacgttacctttccatctcattagagactggctttcagatttggaaattacagttgattctgaagaggttctctttgaaaccgttttgaaatgggttcagagaaatgctgaagagagagagagatactttgaagaactttttaaattgctcaggttgtcccagatgaaacctacctaccttactcgacatgtcaaaccagagaggctggtagccaataatgaagtttgtgtcaagttggtcgctgacgcagtggagagacatgctctgagagctgagaatatacaatctggcacatgccagcaccccacttctcatgtgtcactattgcctcgttatgggcaaaacatggatgtgatcatggttattggaggtgtgtcagaaggaggggactatttaagtgaatgtgtgggatactttgttgatgaggacagatgggtaaatctgccacatattcataatcacctcgatggacatgctgttgcagtaacagaatcctacgtgtatgttgctggatcaatggagccagggtttgctaaaactgtagaaaggtataacccaaatttgaatacatgggaacatgtttgtagtctgatgacaagaaagcattcttttggactaacagaagtcaaagggaagctctatagcattggaggacatggcaactttagtcctggttttaaagatgtgactgtttataatcctgagcttgataaatggcacaacttggaatcggcaccaaagattcttcgagatgtcaaagcactagccattgaagaccggtttgtatacattgccgcccgcactcctgtagaccgggacactgaagatggattaaaggctgtaattacttgctatgatacagagactcgacagtggcaagatgtggaatctttgccgcttattgacaattactgctttttccaaatgtctgtggtcaattcaaacttttatcagacagcatcatgttgtcccaagagttattgtttagaaaacgaagaggcagtaagaaaaattgccagccaagtgtctgatgagatccttgaaagcttgcctccagaagtcctaagcatcgaaggagcagccatttgctattacaaagatgatgtcttcattataggaggctggaaaaacagtgatgatattgataaacagtatcggaaagaagcctaccgatattgtgcggagaggaagaggtggatgcttcttcctcctatgccacaacctcgttgtagagccactgcttgtcacgtgaggatcccataccggtacttgcatggcacacagagataccctatgcctcaaaacctgatgtggcagaaggaccgcatcagacagatgcaagagatacatcgtcacgccctgaacatgaggcgagtgccaagctctcagattgaatgctaggttctctcaagcgtgccgattaaaactgttacacccgtttcgtgaagctgaagatacccaggctgttatttaaaaaagtatgtcgataacttattttctacatgaactgattattaccccatataaaggaaatagagttaaaaactaaagaatgggagactcagttcaatacatggtcattttgttagcttgc

SEQ ID NO: 1663 - DNA, 1942 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggcagctggatgtcatgccgaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagct

SEQ ID NO: 1664 - DNA, 1825 bp, Homo sapiens
ttttgctttgggttccgtcttctcactgcggaccctggattgaaacgatctccccgcggccgccgccgctacctggtgcccgcaggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgagcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttatatcatgaagttcccgctaaaccggcaggcgatgagaaaggaaaccatcactaagatgctctggagtacccgcaccctgttgaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagatgccggcctccctgtctacctgtatgaatttgagcaccacgctcgtggaataatcgtcaaaccccgcactgatggggcagaccatggggatgagatgtacttcctctttgggggccccttcgccacaggcctttccatgggtaaggagaaggcacttagcctccagatgatgaaatactgggccaactttgcccgcacaggaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaat

SEQ ID NO: 1665 - DNA, 2408 bp, Homo sapiens
cttctttccgctccaacgcacggagggtgaggtcggtacgcggtggtggcgtcacggcgccagctcctcccgacgccgagattgggtaactcaaggcgtccctggagtacactgaggataagtgtttgagaaatgctgtctgaaggaatgaagtcagtctatgacaacgtctctctgccgtgaatcattcctgcagatgaaaaagtgtgacttggcagctgccaatctaaaaagggccctcaggatcgcccacaatgcccagcttagcttcttgacaaacaccttaatggcgcagcattgcctgttggctgccatcggctcttgagtgggtggagccggcgcacgtgcaggagccaccagtggtgcaggagcagttggggtccatttcaagccgcggtaaggctggagatctcaagcgataatggagagacagcaaggcgcacgtggacggcgtgttcaccaattaccaaactttttgacctgagcaactagaagaatggagttgccattatttgacacaaagaagactgcaggagggacaggtttgagtagaaatatgaagagctcacccaagtggatgtgagacaggatctcactctgtcacccaggctggagtgcactggcatgatcatagctcactgcaacctcaaactcctgggctcgagcgatcctcccacctcagtctcctgagtagctatgactacggggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacagtaagtgtttgcatggccccaagaactgggaagagtctccccttgctgctaaaaagcctctttaagggtagagctttgggagttctgacatatcagcactagaagggaccttggagatatacataatgctcatattttacagatggggagaccaaagaacagagaagctaagtgccttgctaaagatctcacagctagtagaggtagagctagaattagttccttgggatcttgaccccggcccttggcattcctcccacagtggagatctttgatctgtttgaataggtgactttgaaaaggtgagtttagcgaaaagttttgtgagacactaaaatagattttaaggggaatccagagtcccatagccctatattcaaacctgggactccttaacaaagcagtcctgcttagtctcacagatatttcttgaatgtctttcacatgccaggcactctgctaggcccaagggttacagcagtggccttgctctcatggagcttacattttaatgagaaaaaaaccatgaatgtgtatctggtagacagaaggccagtgtggctggagcggagc

SEQ ID NO: 1666 - DNA, 1726 bp, Homo sapiens
agaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgccagagagaggctggaggagatgcatgtgctctgtcagcctaaggaaacgagtgactcaagtctggtgtgttcccgttatcttcagtactgcagagcaaccaatctctatcttgatttaagaaacatcaagagaaatcatgacagatttaaggaggactttttccagagtggtgaaattggagggcactgtaaacttgacatccgtacattgacgtctgaaggtcagcgcaaaagccctctgcagtcatggtttgctgagctacaaagctatactcagctcaacttcagacctatagaagatgctaaatgtgacattgtcattgaaaaaccaacatatttcatgaaattagatgcaggtgttaacatgtatcaccacttctgtgatttcatcaatctttatattactcagcacgttaataactcattcagtactgacgtgtacatcgtgatgtgggacaccagttcttacggatatggtgacctattctccgacacatggaatgcatttactgattatgacgttatacatttgaaaacttatgattccaaaagggtatgttttaaagaagctgttttttcattactcccccgcatgaggtatgggctgttctataatactcctctgatatctggctgtcaaaatactggactattcagggcatttgcccagcatgtactacacagactaaacatcacacaagaaggacctaaggatggaaaaattcgagtcaccattcttgcacggagcacagaataccggaaaatccttaaccaaaatgagcttgtaaatgcactgaaaacagtatctacatttgaagtccagattgttgattacaagtatagagaacttgggtttttagatcaactaaggatcacacacaacacggacatatttattggaatgcatggagctggtctgacccatttacttttccttccagactgggctgctgtatttgaactgtacaactgtgaagatgaacgctgttacttagacttggccaggctgagaggcgttcactacatcacttggcgacggcagaacaaagtctttcctcaggataagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcatgtggtttttgtgtcattgctatttatcaatagcaataattttgcactgaaaactttttatagttcaaaaattaagcatggactccccagtatactttaactttctttctttctttttttttttttggagacagagtctcactgtcacccaggctggagtgcagtggcatgatctcagtttat

SEQ ID NO: 1667 - DNA, 2362 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggttgcatcatcattttctgctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagct

SEQ ID NO: 1668 - DNA, 2203 bp, Homo sapiens
aaaagtgtgctcacacactgtagacacggctaccatgccatccacagtgttgccatccacagtgttgccatcactcctgcccacagcaggagctggctggagcatgaggtggattctgtgctggagcctcaccctctgcctgatggcgcagacggccttgggtgccttgcacaccaagaggcctcaagtggtcaccaaatatggaaccctgcaaggaaaacagatgcatgtggggaagacacccatccaagtctttttaggagtccccttctccagacctcctctaggtatcctcaggtttgcacctccagaacccccggagccctggaaaggaatcagagatgctaccacctacccgcctgggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgagcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttatatcatgaagttcccgctaaaccggcaggcgatgagaaaggaaaccatcactaagatgctctggagtacccgcaccctgttgaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattagacctgaatttctccacctataaaa

SEQ ID NO: 1669 - DNA, 2243 bp, Homo sapiens
atgacgactccctcctctggaacagccgccgtctcctccgcctcctcctcggtagttcacggctgccccggctccaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagtgggtacatgccctcgccagacgccagctttctgatctgcgtctttagattttttccatcgcctaagcgttacttctccactgatcggttttagagacctgaaacatcacagaagcttctgagtggttctgaagattcaagaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgccagagagaggctggaggagatgcatgtgctctgtcagcctaaggaaacgagtgactcaagtctggtgtgttcccgttatcttcagtactgcagagcaaccaatctctatcttgatttaagaaacatcaagagaaatcatgacagatttaaggaggactttttccagagtggtgaaattggagggcactgtaaacttgacatccgtacattgacgtctgaaggtcagcgcaaaagccctctgcagtcatgagttcttacggatatggtgacctattctccgacacatggaatgcatttactgattatgacgttatacatttgaaaacttatgattccaaaagggtatgttttaaagaagctgttttttcattactcccccgcatgaggtatgggctgttctataatactcctctgatatctggctgtcaaaatactggactattcagggcatttgcccagcatgtactacacagactaaacatcacacaagaaggacctaaggatggaaaaattcgagtcaccattcttgcacggagcacagaataccggaaaatccttaaccaaaatgagcttgtaaatgcactgaaaacagtatctacatttgaagtccagattgttgattacaagtatagagaacttgggtttttagatcaactaaggatcacacacaacacggacatatttattggaatgcatggagctggtctgacccatttacttttccttccagactgggctgctgtatttgaactgtacaactgtgaagatgaacgctgttacttagacttggccaggctgagaggcgttcactacatcacttggcgacggcagaacaaagtctttcctcaggataagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcatgtggtttttgtgtcattgctatttatcaatagcaataattttgcactgaaaactttttatagttcaaaaattaagcatggactccccagtatactttaactttctttctttctttttttttttttggagacagagtctcactgtcacccaggctggagtgcagtggcatgatctcagtttatgcaacttctgcctccccaggttcaagcgattcttttgcctcagccacctgactagctgggattgcagcctgcaccaccacacctggct

SEQ ID NO: 1670 - DNA, 1682 bp, Homo sapiens
cctttcctcatgggacacagaactaggcagaacaggatcaggaagcgatcaaacctaccaaggcagtctcacttctcaatgactggactgtgtgggtactctgctccagacatgcgtggcctcagactcatcatgataccagttgagctgctactttgctacctcctgctgcaccctgtggatgccacttcatatggaaagcagacaaatgtcttgatgcactttcccttgtccttggaatcccagacaccctcctcagaccccttgtcctgccaatttctgcacccaaagtcactgcctggtttcagccacatggcccctctacccaagttcttggtaagcctggctctaaggaatgccctggaggaagctggttgtcaggctgatgtttgggctctacagctacagctctaccgccagggtggtgtgaatgctacacaggtcctcatccagcatcttcgagggctccagaaaggcagaagcacagagaggaacgtgtcagtggaagccctggcctctgctctgcagctgttagccagggagcagcaaagcacaggaagggtcgggcgctccctcccgacagaggactgtgagaatgagaaggagcaagctgtgcacaatgtagtccagctgctgccaggagtgggaaccttctacaacctgggcacagctttgtattatgctactcaaaactgcctgggcaaggccagggaacgaggccgagatggggccatagatctgggatatgaccttctgatgaccatggctgggatgtcaggggggcctatgggtctagcgatcagtgctgcacttaaacctgcattaaggtctggggttcagcagttgatccagtattaccaagatcagaaagacgcaaacatctctcagccggagaccaccaaggagggtttgagggccatctcagatgtgagtgacttggaagaaacaactactctggcttctttcatatcagaagtagtaagttcagctccctactgggggtgggccataatcaagagctatgacttagatcctggggctgggagtcttgagatataaaagaatgtggtaaccacagaattaataactgtactaccctgacaagctatatacatgtcttcaaaattttaatctgatttatccaggaggaaggctgtacagtaaaacgtaagaacgtaaatgtttgggtgttgaagtcacagggtttggtttcgaatctaggctccacttgttagagcctcggtgatcactgaatagtaacttctttcttgaactaagatcagttttgaagtttctaaaggagatagaatgattttaacctcaatgagttgccctgtaaatttaaaatgatacaatgaatctaaaatgcttatcacagtactttcaataaatagctattagccaggtgcggtggctcacgcctgtaatcccagcactgtgagaggctgaggcgggatgatcacctgaggtcaggagttcaagatcagcctgggcaacatggcgaaaccccgtctctacaataaatacaaaaaattatcctggcggagttatgcacgcttgtagtcccaactacctgggaggctgaggcgggagaatcacctgagcctgggaggtcgaggctgcagcgagccgagatcgcgccgctgcattccagcctgggtgacagagcgagaccatgtctc

SEQ ID NO: 1671 - DNA, 3016 bp, Homo sapiens
catcccctgccctggctgcaaccatgagggtcttggcctgcctccttgcggccctggtggggatccaggctgttgagcgcctgcgcctggccgatggcccccatgggtgcgctggccgcctggaggtctggcatggcgggcgctggggcaccgtgtgtgatgacggctgggacctgcgcgatgccgccgtggcctgccggcagctgggctgcggaggggcactggccgccccgggaggcgccttcttcggggagggggcagggcctgtgtggctcagcgagctggcttgccggggcaacgaggggcagctgggcctctgccaccaccggggctggaaggcccacatctgctcccacgaggaggacgcgggcgtcgtctgcgcaggtcagcgtgtggctaactccagggacgactcaacatctcccctggatggggctccctggccagggctgttgctggagctgagccccagcacggaggagcccctggtgacacatgccccccgcccagctgggaacccccagaacgcctcccggaagaagagcccccggcccaagcaggccaagtccacccgggcccctctgctgacgacaggagccccccgccaagagcggctgcgcctggtctctggcccccacaggtgcgccggacgcctggaggtctggcacggcgggcgctggggcaccgtatgtgacgatggctgggacctgcgcgacgctgctgtagcctgccgggaactgggctgtgggggggcgctggctgcccccggcggtgccagattcgggcctggtgcagggcccgtgtggatggacgatgtggggtgtggaggaggagaacaggccctccgagactgcccccgaagcccctggggccggagcaactgtgaccacagcgaggatgcggggctggtctgcaccggcccagcacctcggctgcgcctggccgatggcccccacgggtgcgccggccgcctggaggtctggcacgggggtcgctgggggtcggtgtgtgacgacgcctgggacctgcgagacgccgctgtggcctgccgagagctgggctgcggaggggcgctggccgcccccgggggcgccttctttggggaggggtctggacccatcatcctggacgaccttcggtgtcggggaaacgagacggccttacgattctgcccagctcggccctggggccagcatgactgtcaccaccgcgaggacgccggggccgtgtgtgacggcatgcccctgggctacgtccctcccacggcccccacggacagcaacaactccacgcccagggaggctgcctccaggcccccgtccaccatgacgagccaggctccagggacggcaggcgtttcacctcctccagcctcccctactgtcctttgggagcctggaccggaagccgggtccccccagctgcgcctggtggctgggcccagcaagtgctcaggtcgactggaggtgtggcatgaccagcgctgggggaccgtgtgtgacgatagctgggacatgcgggattcagctgtggtctgccgggagctgggctgtggtggacctcagcagccagaccctgctgctggccgctttggctggggtgcgggccccatctggctagatgatgtgggctgtgtggggaccgaggcttcactgtccgactgccctgctgctccctggggaaagcacaactgcgctcacaatgaggatgttggggtcacctgcactgggcccccaggcctggactccatctcagaccccttcagctggagctggattcctggactggggagagatcgggatgcctggctcccgggagagctggccaccaagccctctgcaagtgtgactgccagtgttctggagaaaacaaccacgaaggccccagggaaaatgcctaagagtactaagaagtgggtgacaaaaaatgcaaagagaccaaccactcaacccccagtgatgccaaccacgaaacactccagggcccaaagccccccagacctaacctcacagaccactgcagcactgaccactgaggcctcccgaagacctacctctgagtttaccagaaggccgaccacggaggccccccagagatggacctctcacaccactgccacgctgacccctcaggccccccgagaacggaccactaagaccatggcaatgctgaccactcaaggcccccaagaaatgacctctgagtccactatcaagagtatccctcaggcctccctggagccatctgctgagatcccagaagggtctccagagtcacccaaagacccggccccctctcccagtgttagcaccactggggaatcaggcctgttccgggttcgtctggccgatgggcccaaccgctgtgctggccggctggaagtgtggcatgccggacgctggggaacagtgtgtgatgacaactgggacctgcgggacgccactgtggcctgctgggaactgggctgtggaaaggtccggcctcgagtaggcaaaacccattacggccctgggactgggcccatctggctggatgacatgggctgtaagggaagcgaggcctcactgagcgactgcccctcgggggcttgggggaagcacaactgtgaccacgaggaagacgtggggctcacctgcactggctacacagactatgacgattatcccccctggacctgggaccccacctcaagagaggacctggccaaggggactaccacagcgggggtacctggacacactctcccctggaggaccacccggcgcccgggtagctcctccccagcaataaggcgcctgccggacacagagccggaagcgggactccgagaggtgatgctcctcgttcaaggactgccagggttgcagcgcctccctagcccatagcgccccctcgtggtggaggcgggcacgtgccgggcacagcggctgcggagacagcgggtccggcctcgggacccctcccgtagggtagggaggcagccaatgagcagaaataaatgcagaatcacaaactg

SEQ ID NO: 1672 - DNA, 749 bp, Homo sapiens
agtcctgtgtccgggccccgaggcacagccagggcaccaggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgagatagatgatacttgttcgtcttttctgtccattgattctcagcctcaggcatccaacgcactggaggagctttgctttatgattatgggaatgctaccaaagcctcaggaacaagatgaaaaagataatactaaaaggtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaatt

SEQ ID NO: 1673 - DNA, 2161 bp, Homo sapiens
atgccatccacagtgttgccatccacagtgttgccatcactcctgcccacagcaggagctggctggagcatgaggtggattctgtgctggagcctcaccctctgcctgatggcgcagacggccttgggtgccttgcacaccaagaggcctcaagtggtcaccaaatatggaaccctgcaaggaaaacagatgcatgtggggaagacacccatccaagtctttttaggagtccccttctccagacctcctctaggtatcctcaggtttgcacctccagaacccccggagccctggaaaggaatcagagatgctaccacctacccgcctgggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgagcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttataatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgaggcctttccatgggtaaggagaaggcacttagcctccagatgatgaaatactgggccaactttgcccgcacaggaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattagacctgaatttctccacctataaaa

SEQ ID NO: 1674 - DNA, 1878 bp, Homo sapiens
aatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttcta

SEQ ID NO: 1675 - DNA, 1776 bp, Homo sapiens
ctctgttgtgactgtaagtgggacaggcagaggcattactttgcctcatttagttttagggggatcagatctagggcagccataatatctggtatttgattttcttactaagcggctgggatttctgtccttttgcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctgtactattaacccatggaaattgaacacactttggaccagatgatctctaaggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcat

SEQ ID NO: 1676 - DNA, 1953 bp, Homo sapiens
cgaggtcctcctcccagggcccggggctggggagcggaagccatcagtgggctcggaggacactgtcccagccaggacacggccatcggtcactaatctgcagcactggaatgtccgcaggccaatcagcgggcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctg

SEQ ID NO: 1677 - DNA, 2162 bp, Homo sapiens
ctgcctcccaggccactcctagactcacgtgcctggccgccccacccaggggcttctgccagccctggcggcgccttggtgctgtgtgggtgtcattggcatgttgaccaacagcctcctgccctgcccagctggagctgtgcccccagctgcgctgcctgaggcctgtgggtgggtgggaggaccagggacggggacagggagatctgggagcctcggcctccaccgcagggtgagcaggtggagcagcagcaggagatgctgggtagggagtgtggctggtcctacctgcgctgccttgctttccctgaagggattctgctcagggaggcagagtctaggcgacctaatttctaggggcgaggacaagaacacagccgcaccgggatgtggctgaccgtctacctccctcctagggggctggcaggggcttctgggacggttttgggacaggtctggggcaccagaaccggctcaggcaggtctcccaccccttaccctgggggtctccatgggaatgaaagccaggagttcatcaggcacccagctgagtcgagggggcgggacccagtgcagcccggcccctgccttggtgccagagctactgccagagggagtcagtgcagtcctgtgtcggacacgcccgcagcctggacccgggatccccatccccctaggatctctgagcctcgggcctctgcacccacatccaaggtgagtctctcggctgccctgagctggggctggatgggccggaccctccattccggctgcagcttcccgcgcagtgagaaggcagcggtccctgagagcccagcagtgccctgggagcctgcagaacgcaggggcggattccgcgtcgcactggccgtcaaggggcggccgcggagggaaggggtgggtcggtgggtctgacagcgggtctgcgtaggcggcagcgtctgtccctcccagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaagatcctggctggctatgacctcgcgctggtgcaggaggtgcgagacccagacctcagcgccgtgtccgcgctcatggagcagatcaacagcgtgtccgagcacgagtacagctttgtgagcagccagcccctgggccgggaccagtacaaggagatgtacctgttcgtgtacaggaaagacgcggtgtcggtcgtggacacctacctgtacccagaccccgaggacgtcttcagccgcgagcccttcgtggtcaagttctcggcccccggcaccggtgagcgggccccgcccctcccctcccgccgagctctgacgcccccaccccttcccgcagcagcacagaacctggtgctgatcccgctgcacgcggcgccgcatcaagccgtggcggagatcgacgcgctctacgacgtgtacctggacgtgatcgacaagtggggcaccgacgacatgctgttcctgggcgacttcaacgccgactgcagctatgtgcgggcgcaggactgggccgccatccgtctgaggagcagtgaggtcttcaagtggctcatccctgacagcgccgacaccacggtgggcaactcagactgcgcctacgaccgcattgtggcctgtggcgcccgcctgcgccggagcctgaagccccagtcggccaccgtgcacgacttccaggaggaattcggcctggaccagactcaggctcttgccatcagcgaccactttccagtggaggtgaccctcaagttccaccgatgactcgaggcctggctggggcatgccacctgcagaccctggctctgaggaatggcccaacagtggccccttcagggtggcagccacccttcagtgaggccccaaggcagagtcggctgggcgtggaccaggggccatggacacgtgatgtgctgctctgtacctccgttccccatctgtgggacgggctgcatccagcgacctcatggggtgttgtgagccccatgaggggtgcagggggcactgcccggcagatgtctgctcaataaatgagctgctcccggtcgggccccac

SEQ ID NO: 1678 - DNA, 2928 bp, Homo sapiens
gggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaaggtgactgtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacagataaggccataccagtgtcctctgctgtatctgaggagacccaccataggtctggttccacccaaagtctgccccttcaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttg

SEQ ID NO: 1679 - DNA, 3547 bp, Homo sapiens
gagagggacagaggctggagaaggatgtatggcctgccctgggcttgtctgttccctcctgagcctgagccccttaccttcctgaccccatgaagcacacactggctctgctggctcccctgctgggcctgggcctggggctggccctgagtcagctggctgcaggggccacagactgcaagttccttggcccggcagagcacctgacattcaccccagcagccagggcccggtggctggcccctcgagttcgtgcgccaggactcctggactccctctatggcaccgtgcgccgcttcctctcggtggtgcagctcaatcctttcccttcagagttggtaaaggccctactgaatgagctggcctccgtgaaggtgaatgaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtcttcctgctgctgaccaccctcttgctgctgattggtgtggtctgtgcctttgtcaccaaccagcgcacgcatgaacagatgggccccagcatcgaggccatgcctgagaccctgctcagcctctggggcctggtctctgatgtcccccaagagctgcaggccgtggcacagcaattctccctgccccaggagcaagtctcagaggagctggatggtgttggtgtgagcattgggagcgcgatccacactcagctcaggagctccgtgtaccccttgctggcggccgtgggcagtttgggccaggtcctgcaggtctccgtgcaccacctgcaaaccttgaatgctacagtggtagagctgcaggccgggcagcaggacctggagccagccatccgggaacaccgggaccgcctccttgagctgctgcaggaggccaggtgccagggagattgtgcaggggccctgagctgggcccgcaccctggagctgggtgctgacttcagccaggtgccctctgtggaccatgtcctgcaccagctaaaaggtgtccccgaggccaacttctccagcatggtccaggaggagaacagcaccttcaacgcccttccagccctggctgccatgcagacatccagcgtggtgcaagagctgaagaaggcagtggcccagcagccggaaggggtgaggacactggctgaagggttcccgggcttggaggcagcttcccgctgggcccaggcactgcaggaggtggaggagagcagccgcccctacctgcaggaggtgcagagatacgagacctacaggtggatcgtgggctgcgtgctgtgctccgtggtcctattcgtggtgctctgcaacctgctgggcctcaatctgggcatctggggcctgtctgccagggacgaccccagccacccagaagccaagggcgaggctggagcccgcttcctcatggcaggtgtgggcctcagcttcctctttgctgcacccctcatcctcctggtgttcgccaccttcctggtgggtggcaacgtgcagacgctggtgtgccagagctgggagaacggcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtggggtgaggtgaccctgaggctgcctgtcctcccctttgatttagcctgggccacaggacttcggtagctcttgccccagagcccaggctggcatccaggcctggactgtccccagttccggcttacctggccccaccttgcctgctcctttccacccctttctgctcacgacccccatcattcacgctcagaatcacatgggacttctgtgcagctgcagagccagcaagtccctccaggtgtcaccccttacccccatgctggtggcatcctcacaggaagagcctgttctccacctgctggagcctggaccctggggtgggacagaggcctcgtccaaccccactccccttcccgtgtgtcttccccctgccaagcctccccctgccaagcctccccctgcccctctctgagcccctcgccccccacaccgtcctcatctggcctcccccctggcccccacttccctcttatgcccttcctggccctttgcttcctcccttagtcccctcttcaccatatctccactgctaccttgctggccccagagaccaccctgcccaaccaaaccactcaggtaacgccactaatcaggcaggggccaccatggcctaggtctgggctggctgcaggccctgcctcatggcctctgagccctccactgccccagggccttgggccctctgcagatctcatccaggatttattggtgtccagtggggtgagggaggcctgtctgaaggccgagcctccctgcctgcacccaagttagaaatgggggtaccagcacttagcttctctctgagtgctggctcccaaggaagggacctgggacctgggccacagtgggggcttgcccttacctcttcagaaggaagcatcttccacagcccccacccaactttcttaggagtgatctggtggccagaacaggattttgcacggccccttttatcctgcgcatgtggcctagggtcatccccagcccatccctgtgtcagccctgagtgctggacactgcgttccagaaatgaggaagaggagagagaagagatggacagacctcagatccattaaagtgttctcacttc

SEQ ID NO: 1680 - DNA, 1714 bp, Homo sapiens
agtcttaacatgctgactgcgaggtgcctgtcagacgacacactggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagatttgctgtcgctttcacagagtcaatgaaggaaatggcacaagcgcagtggaaagcaagacagatctcattggctgtcacaagtgcagttcctgtacagccgcatgctaagggtaaggtctatgtccagagtcaaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaagtcgatccagtgtttacaagggaagtgaaagccaaagtgaaaagagccgctggggtacgattgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagt

SEQ ID NO: 1681 - DNA, 1194 bp, Homo sapiens
actcggcacccacctcctgccagggccgctgctacgaagcctttgacaagcaccaccaatgtcactgcaatgcccgctgccaagagtttgggaactgctgcaaggattttgagagcctgtgtagtgaccacgaggtctcccacagcagtgatgccataacaaaagaggagattcagagcatctctgagaagatctacagggcagacaccaacaaagcccagaaggaagacatcgttctcaatagccaaaactgcatctccccgtcagagaccagaaaccaagtggatcgctgcccaaagccactcttcacttatgtcaatgagaagctgttctccaagcccacctatgcagccttcatcaacctcctcaacaactaccagcgggcaacaggccatggggagcacttcagtgcccaggagctggccgagcaggacgccttcctcagagagatcatgaagacagcagtcatgaaggagctctacagcttcctccatcaccagaatcgctatggctcagagcaagagtttgtcgatgacttgaagaacatgtggtttgggctctattcaagaggcaatgaagagggggactcgagtggctttgaacatgtcttctcaggtgaggtaaaaaaaggcaaggttactggcttccataactggatccgcttctacctggaggagaaggagggtctggttgactattacagtcacatctacgatgggcctgtgccagttaagcctgggaggatatcccttagctgtccggacatatacctgggacaagtccacctatgggaatggcaagaagtacatcgccacagcctacatagtgtcttccacctaatagaacttcgagccagaaaggggcatgagggctcttgcgagactgaagtgctatcttctctggactagagagaagagggagaggactggaagggatcaccaaatctcaaagcaatgagaagcattcctaaatcccaaagtgcccacatgggaaagagataaaatgtacaaattagaaaaatgtggataaacagtcaaacctttatcctctagaattttggcaatgttgactaagaaacagagtccaagcagagaaggtaggaaccctccatagctctctgccctgatgtgtgggggaactaggaagaagtcctttgacctcaccaggcctcatgcttccctttaatgtaaaggg

SEQ ID NO: 1682 - DNA, 575 bp, Homo sapiens
acacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggagctcaaggagtcttgcatccggaaccaggactgcgagactggctgctgccaacgtgctccagacaattgcgagtcgcactgcgcggagaaggggtccgagggcagtctgtgtcaaacgcaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtt

SEQ ID NO: 1683 - DNA, 1421 bp, Homo sapiens
gtcggggaaaggcggggtctcggccggcgctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacaccaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtgagtcgt

SEQ ID NO: 1684 - DNA, 4600 bp, Homo sapiens
agaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggatgctcaccccatttagagaaagaaatccacctccccaaccccaatcaagaacctgctattgtatatcatcatagagccagattacctagggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaag

SEQ ID NO: 1685 - DNA, 1545 bp, Homo sapiens
aagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgaggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatc

SEQ ID NO: 1686 - DNA, 549 bp, Homo sapiens
agttggtgagcttttccggtgctctgcacagatgctggggcgctgagcaaacagccctcagtttctggagctgttccgagtccaggcatcccgatgttggtggatggcccatctgagcggccagccctgtgcttcttgctgttggctgtggcaatgtctttcttcggctcagctctatccatagatgaaacacgggcgcatctgttgttgaaagaaaagatgatgcggctgggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaact

SEQ ID NO: 1687 - DNA, 4554 bp, Homo sapiens
agtccagcagccaccatcaccaccactgcggttgctgctgcagctgcagctgctgctctccctccggctgcttcttcgcgtggccagcagcgaatggagcgatggagcccagactgttctgctggaccactctctttctcctggccgggtggtgcctgccagggttgccctgccccagccggtgcctttgctttaagagcaccgtccgctgcatgcacttgatgctggaccacattcctcaggtaccacagcagaccacagttctagacttgaggtttaacagaataagagaaattccagggagcgccttcaagaaactcaagaatttgaacacacttctgctgaacaacaaccacatcagaaagatttccagaaatgcttttgaaggacttgaaaatttgctatatctgtacctgtataagaatgaaatccatgcactagataagcaaacatttaaaggactcatatctttggaacatctgtatattcatttcaaccaactagaaatgctacagccagagacctttggagaccttctgagattagagcgactatttttgcataacaacaaattatctaaaattccagctgggagcttttctaatctggattcattaaaaagattgcgtctggattccaacgccctggtttgtgactgtgatctgatgtggctgggggagcttttacaaggctttgcccaacacggccacacccaggctgcggctacctgcgaatatcccaggagactccatgggcgtgcagttgcttcagtaacagtagaggaattcaattgccagagcccccgaattacttttgagccgcaggatgtggaggtaccatcaggaaataccgtctacttcacctgccgggcggaaggaaaccccaaacctgagattatttggatacacaacaaccactcattggatttggaagatgatactcgacttaatgtgtttgatgatggcacactcatgatccgaaacaccagagagtcagaccaaggtgtctatcagtgcatggccagaaattccgctggggaagccaagacacagagtgccatgctcagatactccagtcttccagccaaaccaagctttgtaatccagcctcaggacacagaggttttaattggcaccagcacaactttggaatgtatggccacaggccacccacaccctcttatcacttggaccagggacaatggattggagctggatggatccaggcacgtggcaacgtccagtggactttacttacagaacatcacacaacgggatcatggtcgatttacctgtcatgccaacaatagccacggcactgttcaagctgcagcaaacataattgtacaagctcctccacaatttacagtaacccccaaggatcaagtggtgctggaagaacatgctgtagagtggctctgtgaagctgacggcaacccacctcctgttattgtctggacaaaaacaggagggcagctccctgtggaaggccagcatacagttctctcctctggcactttgagaattgaccgtgcagcacagcacgatcaaggccaatatgaatgtcaagcagtcagttcgttgggggtgaaaaaggtgtctgtgcagctgactgtaaaacccaaagctcttgcagtgtttactcaacttcctcaggatacaagtgtcgaggttggaaagaatataaacatttcatgtcatgctcaaggagaaccacagcccataattacttggaataaggaaggtgtgcagattactgagagtggtaaattccatgtggatgatgaaggcacgctgactatctacgacgcagggttccctgaccagggaagatatgaatgtgtggctcggaattcttttggccttgctgtgaccaacatgtttcttacagtcacggctatacagggtagacaagctggcgatgactttgttgaatcttccattcttgatgctgtacagagagttgacagtgcaattaactccacacgaagacatttgttttcacaaaaacctcacacctccagtgacctgctggctcaatttcattacccgcgtgacccactgattgtggaaatggcaagagcaggggagatttttgagcacacgctgcagctgatacgggaacgtgtgaagcaggggctcactgtggacttggaaggcaaagaattccggtacaatgacttggtgtccccgcgctccctcagcctcatcgccaatttatctggatgcacagctcgcaggcctctgccaaactgctccaaccggtgtttccatgcgaagtaccgcgcccacgacggcacgtgcaacaacctgcagcagcccacgtggggcgcggcgctgaccgccttcgcgcgcctgctgcagccagcctaccgggacggcatccgcgcgccccgcgggctcggccttcctgtgggctcccgccagcccctcccgccgccccggctggtcgccacagtgtgggcgcgcgcggcggccgtcacccccgaccacagctacacgcgcatgctcatgcactggggctggtttctagagcacgacttggaccacacagtgcctgcgctgagcacagcccgcttctcggatgggcggccgtgcagctccgtctgcaccaacgaccctccttgtttccccatgaacacccggcacgccgacccccggggcacccacgcgccctgcatgctcttcgcgcgctccagccccgcgtgtgccagcggccgtccctctgcgacggtggattcagtctatgcacgagagcagatcaaccagcaaacagcctacatcgatggctccaacgtttacgggagctcggagcgggaatcccaggctctcagagacccttcggtgcctcggggtctcctgaagacaggctttccttggcctccctccggaaagcccttattgcccttttctacaggcccacccaccgagtgcgcgcgacaggagcaggagagcccctgtttcctggccggggaccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagttgtacggctctccaggtgacattgacctctggcccgcccttatggttgaagacctgattcctggtacaagagtgggaccaacacttatgtgcctgtttgttacccagtttcagcggctaagagatggagataggttctggtatgaaaaccctggagtatttaccccggcacaactcactcagctgaagcaggcgtccctgagccgggtgctttgtgacaatggtgacagcattcagcaagtgcaggctgatgtctttgtaaaggcagaatacccacaggattacctgaactgcagcgagatcccgaaggtggacctgcgagtgtggcaagactgctgtgcagataaacaagctggaggcacgcctgaggcaggcagggtgtacagatgttagaggggttccaaggaaggccgaggagcgctggatgaaagaagactgcactcactgcatttgtgagagtggccaggtcacctgtgtggtggagatttgtcccccggctccctgtcccagtcctgaattggtgaaaggaacctgctgtccagtttgcagagaccgaggaatgccaagtgattccccagagaagcgctaataaaagttttgtgctgttgagccccaaatgggaaatttctcaggaagagacatttaggacttcagaacttttaacttgtagtcacattgttgatatggaaaccactgacttaagcaacttagttcatctaatcttacatatacttacgatcttttattttttcattttctaacataccttgaaataattcaaaactaaaagcaataaagtgcatatgaagtgtttgatcataagaaatatttcttactgtaagctgtcagttttatatgccacacctggaaataaaaagaatatcatggaatattt

SEQ ID NO: 1688 - DNA, 1555 bp, Homo sapiens
ttcatttctccttgagcaggaacagttcatggacgaactctgaggaccattctgaggacaagaggcatccagtgtcatgagtggaacatgcagcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctattcttccaccagaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcaacaggaaatcacatgacgatgagtgtcctgaggaaaatcttcgtgaaagatcttgacatgtgtcccctatacaaactccagaagacagaatgcggcagccacacgaaagaggaaaccaagactgcctgcttgggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtc

SEQ ID NO: 1689 - DNA, 4820 bp, Homo sapiens
cttaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctg

SEQ ID NO: 1690 - DNA, 583 bp, Homo sapiens
actagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggtattaaaggtcactctgcaagagaaaaaaagaaaagaaaggaaaagaaaagaaaaaaaaacatgcttttaactgcagatcaatactgttgaaacagtacaccaagagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaag

SEQ ID NO: 1691 - DNA, 4509 bp, Homo sapiens
agaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattgggggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaag

SEQ ID NO: 1692 - DNA, 1582 bp, Homo sapiens
cctcctccttatcccctcccctcttccctgtcccctttcacagctggctgtagctggccaaggagttctcgattaaagaggaaggggcagtgctcacatttctgggcaggtgtctggaaaatatgaggggccacccctctctgctgctgctatatatggcattaaccacctgcctggatacttcacccagtgaggagacagaccaaggtgagtgtttgggggaagtggcatccagacacttggcgttggcctccccctgactcaggaatgtttctagtccttcctcttccaggagtccaggacccagccccttcctccttcagacccaggaatctggattcccagcccctgctccttcctccaggaccccactgctttccatccccctatgactccagccctagggaccctccatttttctgtccctcatgtctttgggtccagaagtcttcctgggtcccccagaggcccagagcttcctgagtagccatacccggattccaagagccaaccactgggacctggagctgctcacaccagggaacctggaacgggagtgtctggaagagaggtgttcctgggaagaggccagggagtattttgaggacaacactctcacggagcgcttttgggagagctacatctacaatggcaaaggagggcgtggacgagtggatgtggccagcctggctgtggggctgacaggtggcatcctgctcattgtcctggccggcctgggagccttttggtatctgcgctggcgacagcaccgaggccagcagccctgtccccaagaggccgggctcattagccctctgagtcctttgaaccctctgggcccaccgacgcccctgcctccacccccacccccacccccaggcctccccacctatgagcaggcgctggcagcctctggggtacacgacgcacctccacccccctacaccagcctcaggaggcctcactgaagagctgctttcgagacccggctctccgaaccgtgcccctgattcataccggattccggaagccgctaggcctcatagacgccgaagctggacttggagtggggaatggtgggagtaggggtcatccggcccgaggcctgccctggcacacgcgtttccgccgcgtatggatatacacatgttttcggcaacgtgttcccgtgtcctggcccctcacgggcccccacactctcctgaccgtgagggcactggtcagttccgcccccgtggtaggcagacgcgcggggaaattcggacccaggagcccagccccggctgtgccatcttgtgtatgggcagatatgacctgacagccccctccagtgccacagggtacgcacacgcagagccccgcctgtgcacacgcgtgtcttcgtgcactccccgtgcggtacaggggcacttcgtaacccagggaaagggcggggggcatatttgcaagcgcgctcggtgcgggcaggctcgcattgcacccagggagctggagttgagctgttcccctaaataaaaacccttcggaaaggagaccaaaaaaagcagaaataatgcaaaaaataataatgaaatgaactgcg

SEQ ID NO: 1693 - DNA, 2067 bp, Homo sapiens
taggtccaactccagggctaacttccagttgcaaccgctgctcccgcccgcgggaggtgcctcgcaccgccccccgaccccctccatcccctccacccactcacccactccctgtgggtccctgcagaagcggcccggcaggctctgcccaccggcccctcctggcctttccccatcccgcacacacctcagctccaggacactcttcccgggaggaactctgctcacaaagcccaaggaccagacagaacggcccttcctcccctcacccacctgaaccaccccagaaagccctgagcagaggccaggccacccagccctctgccatgtatgaaccacctggtcccacaccttccgggtgtcccaggccccctcacctcacacctcaacaccgcagctctaattattttaaaccccacatctttttcttttttttcttcttgatctttaaaagaatatcatgacaaaaaaaaccccacatcttaaattcagatactcacggccaggcacggtggctcacacccgtaatcccagcactttgggaggccaaggcgggcagatcagttgagcccaggagttcaagaccagcccgggcaacacagcaagaccctgtctctactaaaaataaaaaaaaattaaaaaacaaaaaacaaacaaacaaaaaaaccccaggtgcagtggtgcctgtggtcccaagtactcaggaagctgaggcgagaggatggcttgagcccaggagttggaggctgcagtgagctacagttgcactgctgcactccagcctgggtgacagaatgagaactctgtctctaggggaaaaaaaaaatcggaaactcgggctgagagagggcaggtcacctgccagaggcccgcaggtggggctggccctgctgcacctggagggtggttctctccgagccagcctttcaggtaggcactgtgactgtccccacagcacaggtgagaaagctgcatcacagagaacttgttaagtgacttgcccaaggccacacagcggccaggggtggaggtggaaatctgagtcgggcggtctggcttcaatgtcaacacgcatcaccgctgcacctggctgtcctagagatgactctcgaagacattgtgcagagagaggtgtggggcacggtggtggccagaggagccccagcccctcccgggcctgtccccacacgaggggccgcctcacgccgcctctctgtttctcccgccagcacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgtgccagct

SEQ ID NO: 1694 - DNA, 4086 bp, Homo sapiens
aataccagcaacaactcctaccttccctgcatctgtcatcacttatgaaacccaaacagagagatctagagcacaaacaatacaaagagaacaggagcctcaaaagaagaacaggactgacccaaacatctctccagaccagagttctggcttcactacacccactgctatgacacctcctgttctaaccacagccgaaacttcagtcaagcccagtgtctctgcattcactcattccccaccagaaaacacaactgggatttcaagcacaatcagttttcattcaagaactcttaatctgacagatgtgattgaagaactagcccaagcaagtactcagactttgaagagcacaattgcttctgaaacaactttgtccagcaaatcacaccagagtaccacaactaggaaagcaatcattagacactcaaccataccaccattcttgagcagcagtgctactctaatgccagttcccatctcccctccctttactcagagagcagttactgacaacgtggcgactcccatttccgggcttatgacaaatacagtggtcaagctgcacgaatcctcaaggcacaatgctaaaccacagcaattagtagcagaggttgcaacatcccccaaggttcacccaaatgccaagttcacaattggaaccactcacttcatctactctaatctgttacattctactcccatgccagcactaacaacagttaaatcacagaattctaaattaactccatctccctgggcagaaaaccaattttggcacaaaccatactcagaaattgctgaaaaaggcaaaaagccagaagtaagcatgttggctactacaggcctgtccgaggccaccactcttgtttcagattgggatggacagaagaacacaaagaagagtgactttgataagaaaccagttcaagaagcaacaacttccaaactccttccctttgactctttgtctaggtatatatttgaaaagcccaggatagttggaggaaaagctgcaagttttactattccagctaactcagatgcctttcttccctgtgaagctgttggaaatcccctgcccaccattcattggaccagagtcccatcaggacttgatttatctaagaggaaacagaatagcagggtccaggttctccccaatggtaccctgtccatccagagggtggaaattcaggaccgcggacagtacttgtgttccgcatccaatctgtttggcacagaccaccttcatgtcaccttgtctgtggtttcctatcctcccaggatcctggagagacgtaccaaagagatcacagttcattccggaagcactgtggaactgaagtgcagagcagaaggtaggccaagccctacagttacctggattcttgcaaaccaaacagttgtctcagaatcatcccagggaagtaggcaggctgtggtgacggttgacggaacattggtcctccacaatctcagtatttatgaccgtggcttttacaaatgtgtggccagcaacccaggtggccaggattcactgctggttaaaatacaagtcattgcagcaccacctgttattctagagcaaaggaggcaagtcattgtaggcacttggggtgaaagtttaaaactgccctgtactgcaaaaggaactcctcagcccagcgtttactgggtcctctctgatggcactgaagtgaaaccattacagtttaccaattccaagttgttcttattttcaaatgggactttgtatataagaaacctagcctcttcagacaggggcacttatgaatgcattgctaccagttccactggttcggagcgaagagtagtaatgcttacaatggaagagcgagtgaccagccccaggatagaagctgcatcccagaaaaggactgaagtgaattttggggacaaattactactgaactgctcagccactggggagcccaaaccccaaataatgtggaggttaccatccaaggctgtggtcgaccagcagcatagagtggcagctggatccacgtctaccctaatggatccctgtttattggatcagtaacagaaaaagacagtggtgtctacttgtgtgtggcaagaaacaaaatgggggatgatctgatactgatgcatgttagcctaagactgaaacctgccaaaattgaccacaagcagtattttagaaagcaagtgctccatgggaaagatttccaagtagattgcaaagcttccggctccccagtgccagagatatcttggagtttgcctgatggaaccatgatcaacaatgcaatgcaagccgatgacagtggccacaggactaggagatatacccttttcaacaatggaactttatacttcaacaaagttggggtagcggaggaaggagattatacttgctatgcccagaacaccctagggaaagatgaaatgaaggtccacttaacagttataacagctgctccccggataaggcagagtaacaaaaccaacaagagaatcaaagctggagacacagctgtccttgactgtgaggtcactggggatcccaaaccaaaaatattttggttgctgccttccaatgacatgatttccttctccattgataggtacacatttcatgccaatgggtctttgaccatcaacaaagtgaaactgctcgattctggagagtacgtatgtgtagcccgaaatcccagtggggatgacaccaaaatgtacaaactggatgtggtctctaaacctccattaatcaatggtctgtatacaaacagaactgttattaaagccacagctgtgagacattccaaaaaacactttgactgcagagctgaagggacaccatctcctgaagtcatgtggatcatgccagacaatattttcctcacagccccatactatggaagcagaatcacagtccataaaaatggaaccttggaaattaggaatgtgaggctttcagattcagccgactttatctgtgtggcccgaaatgaaggtggagagagcgtgttggtagtacagttagaagtactggaaatgctgagaagaccgacatttagaaatccatttaatgaaaaaatagttgcccagctgggaaagtccacagcattgaattgctctgttgatggtaacccaccacctgaaataatctggattttaccaaatggcacacgattttccaatggaccacaaagttatcagtatctgatagcaagcaatggttcttttatcatttctaaaacaactcgggaggatgcaggaaaatatcgctgtgcagctaggaataaagttggctatattgagaaattagtcatattagaaattggccagaagccagttattcttacctatgcaccagggacagtaaaaggcatcagtggagaatctctatcactgcattgtgtgtctgatggaatccctaagccaaatatcaaatggactatgccaagtggttatgtagtagacaggcctcaaattaatgggaaatacatattgcatgacaatggcaccttagtcattaaagaagcaacagcttatgacagaggaaactatatctgtaaggctcaaaatagtgttggtcatacactgattactgttccagtaatgattgtagcctaccctccccgaattacaaatcgtccacccaggagtattgtcaccaggacaggggcagcctttcagctccactgtgtggccttgggagttcccaagccagaaatcacatgggagatgcctgaccactcccttctctcaacggcaagtaaagagaggacacatggaagtgagcagcttcacttacaaggtaccctagtcattcagaatccccaaacctccgattctgggatatacaaatgcacagcaaagaacccacttggtagtgattatgcagcaacgtatattcaagtaatctgacatgaaataataaagtcaacaacatctgggcagaatttattttttggaagaagtttaatcaaaggcagccataggcatgtaaatgaatttgaatacatttacagtattaaatttacaatgaacatgcaaaataaaaggacttgtaaataaatgcattatgaactg

SEQ ID NO: 1695 - DNA, 1072 bp, Homo sapiens
acattcgcagcccgggcagccctgctgcgcaccgggcctcgcgccccgcgccccgcgccccgcgccccgcgccccgcaccgcccatccaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggagg

SEQ ID NO: 1696 - DNA, 729 bp, Homo sapiens
atgtttcaaactgggggcctcattgtcttctacgggctgttagcccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaa

SEQ ID NO: 1697 - DNA, 1892 bp, Homo sapiens
gtgcagtctgggacgcgggatgcttggcgctctacctcgccgcccctgagccttcccgtccgcctcgccacgcgcccggacggcctggggttgctgcccgtcagtctcgaaagaaacttggggactgtggcagccatggagccagtgtagtgccacatgtggggatggtgtcagagagcgtcgccgagtgtgtctcacttccttcccctccagtcctgtctgccctggaatgtccttggaggcctccctgtgttccctggaggagtgtgctgctttccagccatccagcccatctcctcttcagccccagggtccagtgaagtccaacaacatcgtgactgtcactggtatatccttgtgcttgttcatcatcattgccactgtgctcatcacgctgtggaggaggttcggccggccagccaagtgcagcacacctgctcgacacaactccatccactcccccagcttccggaagaactcggacgaggagaatatctgcgagctgagcgagcagcgcgggagcttctcggatgggggagacgggcccacggggagtccaggggacacaggcatccctctgacctacaggcggagcgggccggtacctcccgaggatgatgcctctggcagcgagagcttccagtccaacgcccagaagataatcccacctctgttcagctaccgccttgcccagcagcagttaaaggagatgaaaaagaaaggtctgacggaaactaccaaagtgtatcacgtgtctcagagtcccctgacagacactgccattgatgcggcccccagcgctcccttagatttggaaagcccggaagaagctgcagcaaacaagttccggatcaaatccccatttccggagcagcccgcggtcagtgccggggaaaggcctccctccaggctggatctaaatgtgactcaggccagttgtgccataagccccagccagactctgatccgcaagtcacaggcaaggcacgtgggcagcagagggggcccgtccgaaaggagccatgccaggaacgcccatttcaggaggacagcgagtttccatgaagccaggcaggcccggccgttccgagagaggagcatgtccactctgactccacggcaggcccctgcctacagctctaggacgcggacctgcgagcaggcagaggacagatttaggcctcagagtcgaggtgcccacctgtttcctgaaaaactggagcatttccaagaggcaagtggaacccgtggtccattaaaccctctccctaaatcctacactttggggcagcccttgaggaaaccagaccttggggatcaccaggcaggattagtggccggaattgagagaacagagccccacagagctcgtcggggaccgtcccccagtcacaagagtgtctcaaggaagcagtcttctcccatatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagctttacacagctggggtctgctactcgcgttttgtagacttttgtgtaactatttgtaccgtaggacagaatgtgaggaggaagtaacacacagaggaggatgtgtgtgtatgcatgtgtttgaattcacaaggaagaaattatttatcttgagctttttcctttgttattcaatttctattgatttattagtaataacaatgataataaaatgtaaatgagc

SEQ ID NO: 1698 - DNA, 2415 bp, Homo sapiens; identical to SEQ ID NO: 1174

SEQ ID NO: 1699 - DNA, 1558 bp, Homo sapiens
agacagacagggggttgtacagaagaggtccggtttcttgaagcagctggaagtcctggatagttcccacctgaaagtctgtttgcaaaaggagcaactgtgttgaacaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgtggtgtttccgtaccaacccagccggggccggtaccagttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcggcctctccagacctgccttcccagccgggggctgcgggcctcggaccccggctggcccggcggcggggaggggaggcgggggcgcctccggcggcgagatgcagaggtgaccctcggacccgctgccgttcgcgaaccctagcagaggactcagccaccgccggggggagggtgaggcggccgggggcattaactgacctctgagtacagcaataaaataacctggggatcttt

SEQ ID NO: 1700 - DNA, 3038 bp, Homo sapiens
actgcccttacaaagctaccagcctcacggagaaggcgcagtccctgtccacagagacacagccttgccccagttactgcccacctgcaagagatccacatttctgccctccagagctcccaaactgatgggggagagagacatcatcccccagctctgggagtttccagtctgatggaggagacagagcctgcttcggtaactctcactctgcgggggaagactcagccctatccagggagctcccacactttcaatggggaggcccacccagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaacaaccagctccaggaactcccctacaatgagctgtcccgcctcagtggcctgcgaaccctcaacctccacaacaacctcatctcctccgaaggcctgcctgacgaggccttcgagtccctcacccagctgcagcacctctgcgtggcacaacaagaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccgctgcggggcctgcacacgctgcacctctatggcaatgggctggaccgcgtgcctccagccctgccccgccgcctgcgtgccctggtgctgccccacaaccacgtggccgcgctgggtgcccgtgacctggtcgccacaccgggcctgacggagcttaacctggcctataaccgcctggccagcgcccgtgtgcaccaccgggccttccgccggttgcgtgccctgcgcagcctcgacctggcagggaatcagctaacccggctgcccatgggcctgcccactggcctgcgcaccctgcagctgcaacgcaaccagctgcggatgctcgagcccgagcctctggccggcctggaccaactgcgggagctcagcctggcgcacaaccggctccgggtcggcgacatcgggccaggcacctggcatgagctccaagccctccaggtcaggcacaggctggttagccacactgtccccagggcccctccatccccctgcctgccctgccacgtcccaaacattctagttagctggtaaagcaatcagaacaagaaaatgataagagtgggttagaaggtgatgaggaggctgggtgaggtggctcatgcctgtaatcccagcactttggggagccaaggcaggagaatcgctttaggctatgggtttgagaccagcctggcaacacagcaagaccctatctctaccaaaaaaacatagccaagcgtggtggcacatgcctgtagtcccagctattcaggaggctgaggcaggaggatcgcttgagcccagaagtttgaggctgcaatgagccgtgatcgggccactgccctctagactgggcaacagagcaagaccctgtctcttgaaaaaaaaagtgatgaaagaggtatggtgcgattcaatgactgactcatttaatcaagtggggacctgtctgtctgtgccttcctgggaagggccttagtttacctctgcagaagggaggaatttggcaatcatggggggtggggggcagaagggccaggctggtatgaagggggcaggggactctcagagaggttgggggctggctgagctgagtggcccaggcctggggctgccacgatgccatctataaccccctgcccagatgctggacctcagccacaatgagctgtcctttgtgcccccggacctgcctgaggccctagaggagctgcacctcgagggcaaccgcatcggccacgtgggccccgaggccttcctcagcacaccccgcctgcgtgccctcttcctcaggtgccccgagggtgaccggaggggtggaggtgggcaggggagggcctgggagggtcatgaccgcctctctgtgcagggccaacaggcttcacatgacgagcatcgcggctgaggccttcctggggctcccaaacctgcgtgtggtggacacggcagggaatccggagcaggtcctgatccggctgcctcccaccaccccacgtgggccacgggcagggggcccctgatcctagagaggcccagcagagcagctcagactcctgggactccgctgggccgtggactgaggagacaacgcccaccaggggcccttggtctggctctcctgggcctccagggctgggcctgctctgcctgccactggccgagacacagaggcacacagctggcatactccaggctcacagaccacgccggcctggcgggacacaccctaccccaaactcccaacacagatggaggcagcaacaataaagccaaacccttccagcactcagcacggaccaggcaccctttgggggctctgtccacggactcctccccacaaccagtccagctggggaaactgaggctctgggatgctaagtgggtcaggactgaattttgaggtcttgaggcacacactggggtcaccaaacagcaccctgtgcgacctagccacgtgtgattgcagggacgcccaaggccacccactgaaaaaacactgggtgacagatatagggaccctcacatgtatccccccccacagcaagcatgggaatgaaatgcatccttcaa

SEQ ID NO: 1701 - DNA, 1154 bp, Homo sapiens
tctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaaggcagccctctgtggaaccccaaccccgagcctggcgtccggcctgtggcgcaccctgcaagtgggctggaacatgcagctgctccgcgggcttggtgtcctttgtcgaagtggagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgagcccagtgtgccaccaaggtgcattttcccttccacacctgtgacctga

SEQ ID NO: 1702 - DNA, 1553 bp, Homo sapiens
atgcttgataccaacttgattcttctacctttgttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgttactgtttatgaaaaactaaatttttaatcatgaataatttattaaattaaataaatttattcatagaaacttttctgggttttagtaaaattgctaaatcaaaccaagattttaatatatcagcatttactttgtacccttataacatttcactcttgacttgatttgagaaacatgtttattttttgaatgttcttgtgttcaactaattttctgctgtggaaataaatacttatgatatat

SEQ ID NO: 1703 - DNA, 1513 bp, Homo sapiens
aagtcctggtgtctttaaaaggatcagcttgaggaataaggctcgtctgagagctgtgacattcatctgactctagtgaaagtccaacagccactccctttttggcctccaactgggcaccatgagggcctgcatctccctggtattggccgtgctgtgtggcctggcctgggctgacttgtactcggcacccacctcctgccagggccgctgctacgaagcctttgacaagcaccaccaatgtcactgcaatgcccgctgccaagagtttgggaactgctgcaaggattttgagagcctgtgtagtgaccacgaggtctcccacagcagtgatgccataacaaaagaggagattcagagcatctctgagaagatctacagggcagacaccaacaaagcccagaaggaagacatcgttctcaatagccaaaactgcatctccccgtcagagaccagaaaccaagtggatcgctgcccaaagccactcttcacttatgtcaatgagaagctgttctccaagcccacctatgcagccttcatcaacctcctcaacaactaccagcgggcaacaggccatggggagcacttcagtgcccaggagctggccgagcaggacgccttcctcagagagatcatgaagacagcagtcatgaaggagctctacagcttcctccatcaccagaatcgctatggctcagagcaagagtttgtcgatgacttgaagaacatgtggtttgggctctattcaagaggcaatgaagagggggactcgagtggctttgaacatgtcttctcaggtgaggtaaaaaaaggcaaggttactggcttccataactggatccgcttctacctggaggagaaggagggtctggttgactattacagtcacatctacgatgggccttgggattcttaccccgatgtgctggcaatgcagttcaactgggacggctactataaggaagtgggctctgctttcatcggcagcagccctgagtttgagtttgcactctactccctgtgcttcatcgccaggccaggcaaagtgtgccagttaagcctgggaggatatcccttagctgtccggacatatacctgggacaagtccacctatgggaatggcaagaagtacatcgccacagcctacatagtgtcttccacctaatagaacttcgagccagaaaggggcatgagggctcttgcgagactgaagtgctatcttctctggactagagagaagagggagaggactggaagggatcaccaaatctcaaagcaatgagaagcattcctaaatcccaaagtgcccacatgggaaagagataaaatgtacaaattagaaaaatgtggataaacagtcaaacctttatcctctagaattttggcaatgttgactaagaaacagagtccaagcagagaaggtaggaaccctccatagctctctgccctgatgtgtgggggaactaggaagaagtcctttgacctcaccaggcctcatgcttccctttaatgt

SEQ ID NO: 1704 - DNA, 2077 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagct

SEQ ID NO: 1705 - DNA, 5918 bp, Homo sapiens
ctccgcaggcgccttctgcggcaggcggacagatcctcggcgcggcagggccggggcaagctggacgcagcatgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcgacgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatgaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctagcgccgaggcagcgggcgggcgggcgggcgggcgccagggcggggccgagcgagagcgggcgccttggcccggccgccgcggacttggcccgcgagggctttcccaggtggggggagggagggggcggggccgcacggcgcggggggcgggaccctcggcggcccctccccctacccccaccctgcgcgctctgggcgggagccgcgtgcacgcggggcggggtgcgccgccggccgggccctggagaaatgacgagacgtagctacctcacggggctccttccagagcagagacgcgcttccctgggcctgggcgcggccgccgtggaggggctgggggcagcctgccctggggcccgggggcgggcgcagaatcgcacaactggggccccaggcgcggggcgtggatggcgcggagacgtggacgggaggagaactgtgaattctcaagcccgtagtgtgggcggggcgcggagcacccaccaaaccaccacccgacacgcagccgacgggatccccccctttctccccggccccttctagcagttccccgcgggccacctggctgtcacagcctggactcctccatctgaaggggcctggcagcatttggggagtggacagctcctgtccagccagcatgccccaggcggcctctgtctccactgctacctgctgagtgggtcctactgggtgggggcttggggtcggtgagtggttcacctgtggagagaggagaggaagcccctgctgctgcctgtctctgcccctgcccctgcccctgcccagcgtggggctggcccatccggaaggcagtgggcccagggacacccctgagaagcccaagccgggtggtcaccgcctcatgctggagctgcctgttggaggaggcatcgcaaacgcaaaacctcccagagagtttccttttggaaacttggaaccagccctttttatgacgttttccagggggagggggaggggcactggctgggtttacggcagtgacactatttatgtaaatgacatcagctcccgcaaggcccctcagcaatgtcaacagctggaaagggcctgaacgggcttggagtctgcaggctgcgaaggcacttgggcctggcttggggccgggggcttgtttgagctgggatggggtttgctggctcagtgaagtaccagagtgcctgagccatgggtgggcaggggcacaggaatgaccaggttcctgggggccaaggaggccatgctggcttctccaagggaaggcacagaggctgccggcctgccccctacagctgtcttgggtctggcctgggccacaccttgaccgtgcctttccagacggtctttgtggagtctgcccgtgccctccactgtgccccagccctccttccaaaatctcctagagacacggtcctcaagcaggcagccccttttgttctgacctcctcacacagggtccattcctgtgccctggggcctcctggctccctgccttcctgggctctctgcactgcccgggcctctggcccacatcctcacacccggcgcactgaattaagaggcctggctcccctcacagtcaggaaattggtttcactttcccggccagagtttggctgctcaaaagggtcataccaagtatgaagctcggcccccggtggtctggcttccctccgccttccccacatttacccgcatcacggctgccatttattgagcacctgctgtgtgccaggcactttacccacatgctcccagtgtgtactcatgacaaccctgtgggacagggactcattatcaccagcaaggagactggagtacacgtgcccaaggtcatgctgcaaattggtggcaggactggggctcaaactccagagcccgactttctgaccaggggccacgctggccctcactgcactccagctctgcagcctacccgcccaatccctgtgcaggctgggagggtgctcttgggggagtggccaccgagcccctggccctggttactgcctcttgaggacactggcatctgggctggagaacaggagcccggggtggggtagggcatggggacaatcacatcttcagaggaggcagcaaagtggtgcgggatgcagggacggacttgccagatggcagctccaggttccaggaaggcaggccttggatgctccgaagaggtggtagaaaggtgtttttagaaaggtgttttggctgcctcagggtggttggagagactccaggagagactggcagaggtgcctcaggggcagggagcagacagacctgccctgggaaggggcatttggcttccctgaatccagcccaaggctagaagacagggcccctctccaagctgtcagcgcccctcggatgcccagtgtggtgtgctgggcgccatcagcatcacaaggcactacgctgctggggcggttgtcctatttctgtctatgccagtgtggtttcttcaccctgcccagaagggctgtggcagccccacgatatcccaccctgggtctgggtctcacgggtgtcctgtgaggggcttgcatttgtggtggtctctgaggccacctcagcaacggagctggcgacacgccaagcaacaaggcatcttgcggaaaattcagccagtgtcctgcccctcccttcggctcagcaccccgcagggcacaggctgtccgcccggtggtctggcccttggggaatgcgtcagggtgaccagatccaccatgctagcagccaggtcactgttgggattgcacggtcgtcacgagctgcctttcctatccacacacccagccaggacccagcccaccactcccgactgcagccccggcctctgcggtgagcaccatccttgggaaagcacccctcctccactccggtgccccactccaaggagcagagggaaatgggaattgaggtgtcccggtttgtacagttaggaagggatgtaaaacggaactagattttgattttgaagagtgtattaaccagaattgtgctatgtaggtgtttgtttgaagaaaaacataccagattagtctttgtttttgaaacagcttccccagttgtcctttttcttaccagctgggtggtctggtgcccctgacagctgagtgcctgctttacggacacgcagtaatgccgaagatttgcgggggaggacatagggctgtccccgggattcacctgctggctgtggtctctgcccactgcttctgtccttggaaagcagggcaggaggcagcatccccaggggcctctatgtgggagggagggacacctggggtcacaacccagggagggagggtcacagcccagggaggctgggagctgctccaaggccctggaactctgcctcagtcgcggcatgctggagaggggtacggacttactttcttggagttgtcccaggttggaatgagactgaactcaagaagagaccctaagggactggggaatggttcctgccttcaggaaagtgaaagacgcttaggctgtcaacacttaaaggaagtccccttgaagcccagagtggacagactagacccattgatggggccactggccatggtccgtggacaagacattcctgtgggccatggcacaccgggggggatcaaaatgtgtacttgtggggtctcgccccttgccaaaagccaaaccagtcccactcctgtcattggacgtttcttcccattccctcctcccaaatgcacttcccctcctccctctgccccctcctgtgttttggatttctgttcactcagaattgtaaatgtttagttgtgaccatgacgtattgtttgggtcaatgtccctttccaatgcatactaatatattatggttattatatatgaatatatttaatgacatggaaaaagttgtggattttctttctttccttttttttgggggggggtggggggttggttagagttgtaatggacccagatggaacttgtaatgtgggccccacatgatagaactaaattcagatatcattaaataaactcttgtacacta

SEQ ID NO: 1706 - DNA, 1156 bp, Homo sapiens
atcatttgcatgtctagctggagaataaaaataatatatcatttgcatgtcttagtaatgaagtcatgggtgtcgtggcatgagatcagctggagggagaggagagattaaagtgaggagagagctacaaccaagtaagcaagtgtcagggctcaccaaccatgcaaggacagggcaggagaagaggaacctgcaaaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagtgagttgaatgaaaatatttgcaaaaaagtccaagctggaagcacctgcagaattaatcacatgctcttatttcgttgat

SEQ ID NO: 1707 - DNA, 1065 bp, Homo sapiens
atggccccggcccgccgccccgccggagcccgcctgctgctcgtctacgcgggcctgctggccgccgccgccgcgggcctggggtccccggagcctggggcgccctcgaggagccgcgcccgcagggagccgccgcccgggaacgagctgccccggggccccggggagagccgcgcggggccggccgctcgtccgccggagcccaccgctgagcgtgcacacagcgtcgacccccgggacgcctggatgctcttcgtcaggcagagtgacaagggtgtcaatggcaagaagaggagcaggggcaaggccaagaagctgaagttcggcttgccagggccccctgggcctcccggtccccagggccccccaggccccatcatcccacccgaggcgctgctgaaggagttccagctgctgctgaaaggtgcggtgcggcagcgggagcgcgcggagcccgaaccctgtacgtgtggccccgccgggccggtcgctgcgagcctcgccccggtctcggccaccgccggggaggacgacgacgacgtggtgggggacgtgctggcactgctggccgcgcccctggccccggggccgcgggcgccgcgcgtggaggccgctttcctctgccgcctgcgccgggacgcgttggtggagcggcgcgcgctgcacgagcttggcgtctactacctgcccgacgccgagggtgccttccgccgcggcccgggcctgaacttgaccagcggccagtacagggcgcccgtggctggcttctacgctctcgccgccacgctgcacgtggcgctcggggagccgccgaggagggggccgccgcgcccccgggaccacctgcgcctgctcatctgcatccagtcccggtgccagcgcaacgcctccctggaggccatcatgggcctggagagcagcagtgagctcttcaccatctctgtgaatggcgtcctgtacctgcagatggggcagtggacctccgtgttcttggacaacgccagcggctgctccctcacagtgcgcagtggctcccacttcagtgctgtcctcctgggcgtgtga

SEQ ID NO: 1708 - DNA, 3047 bp, Homo sapiens
gagccccgggaggaggtgctcctgtgcagccccactgagtcagctcatctatcgcctgccctccacctggccagtccctgcgggcatctaactgctaagcctccgctcagccaacacccagttggtcagtctggtcacagtccagcaaaaagagggactgccactctaacccaccagtgacaccactcttcccggctggatggtcaattagctctggcatgagagaatgtcactgccgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgca

SEQ ID NO: 1709 - DNA, 3047 bp, Homo sapiens
gagccccgggaggaggtgctcctgtgcagccccactgagtcagctcatctatcgcctgccctccacctggccagtccctgcgggcatctaactgctaagcctccgctcagccaacacccagttggtcagtctggtcacagtccagcaaaaagagggactgccactctaacccaccagtgacaccactcttcccggctggatggtcaattagctctggcatgagagaatgtcactgccgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgca

SEQ ID NO: 1710 - DNA, 4199 bp, Homo sapiens
atgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 1711 - DNA, 2942 bp, Homo sapiens; identical to SEQ ID NO: 810

SEQ ID NO: 1712 - DNA, 886 bp, Homo sapiens
gtcagggacactgagaggtgggtgtgtgcatgccacatttagcctcgctgtttacagccagttcaagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggaggggtgagtggctcagcttcctgggaatctgtttcctgagcaggggactggagggtggggagtgtggagaatgggcatccaggatcccttctcctgctgggaagctgtcactctgaggagggggctagccagcattgtctcctccatgccaatgagccagtggagagatacaagaagggacctgaaacctgcccaggcctgatgcagggatggggga

SEQ ID NO: 1713 - DNA, 913 bp, Homo sapiens
aaggctggcaaaaaggagaccagacaggaggcgtctgtagagatatcatgaacttcaacttagctttgttttccagagactggagctaaactgggctttcaacatcatcatgaagtttatcctcctctgggctctcttgaatctgactgttgctttggcctttaatccagattacacagtcagctccactcccccttacttggtctatttgaaatctgactacttgccctgcgctggagtcctgatccacccgctttgggtgatcacagctgcacactgcaatttaccaaagcttcgggtgatattgggggttacaatcccagcagactctaatgaaaagcatctgcaagtgattggctatgagaagatgattcatcatccacacttctcagtcacttctattgatcatgacatcatgctaatcaagctgaaaacagaggctgaactcaatgactatgtgaaattagccaacctgccctaccaaactatctctgaaaataccatgtgctctgtctctacctggagctacaatgtgtgtgatatctacaaagagcccgattcactgcaaactgtgaacatctctgtaatctccaagcctcagtgtcgcgatgcctataaaacctacaacatcacggaaaatatgctgtgtgtgggcattgtgccaggaaggaggcagccctgcaaggaagtttctgctgccccggcaatctgcaatgggatgcttcaaggaatcctgtcttttgcggatggatgtgttttgagagccgatgttggcatctatgccaaaattttttactatataccctggattgaaaatgtaatccaaaataactgagctgtggcagttgtggaccatatgacacagcttgtccccatcgttcacctttagaattaaatataaattaactcctca

SEQ ID NO: 1714 - DNA, 2054 bp, Homo sapiens
agaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagc

SEQ ID NO: 1715 - DNA, 2305 bp, Homo sapiens; identical to SEQ ID NO: 1383

SEQ ID NO: 1716 - DNA, 2942 bp, Homo sapiens; identical to SEQ ID NO: 810

SEQ ID NO: 1717 - DNA, 4048 bp, Homo sapiens
atgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 1718 - DNA, 1593 bp, Homo sapiens; identical to SEQ ID NO: 674

SEQ ID NO: 1719 - DNA, 3047 bp, Homo sapiens; identical to SEQ ID NO: 1708

SEQ ID NO: 1720 - DNA, 463 bp, Homo sapiens
tcacgtgcctgcgccggcagcgctcccactttcctgtccggtgcggccccgggtccctgtattttgggtccggcctgctcgccgtccgctccgtccgcccttagacctgttgcccagcatccctgcagttcgcgcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgca

SEQ ID NO: 1721 - DNA, 3949 bp, Homo sapiens
gtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 1722 - DNA, 720 bp, Homo sapiens; identical to SEQ ID NO: 814

SEQ ID NO: 1723 - DNA, 5220 bp, Homo sapiens
atgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtcaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccagctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagc

SEQ ID NO: 1724 - DNA, 2204 bp, Homo sapiens
tcaacgtcagagccggggggcgagcccagcgctcctccccgcaaatgatcccgccccaggggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctg

SEQ ID NO: 1725 - DNA, 1347 bp, Homo sapiens; identical to SEQ ID NO: 1414

SEQ ID NO: 1726 - DNA, 2757 bp, Homo sapiens
agtttggttcttgggggctagacaagtttcttccccggtggggcggctgaacactcttcccaagtacctgctttgggtccaagtttcctacctatgtctctagtctgtagggatttcttgatttctaactcactattttcaccaatcctggggaaaatatgtatcgacctaaggttaaattccacctggcccaggagcctcctttggaaaccaggaagccgggaatctcgttgcaaaggaatcctgggcctcagaggagtcgttgcctctgcctcatagcataccccgacactgtctctgttttgggatgcagggttctgtttctgtctttttgagaagttcctggtttaattcactctcccatgataaactgttgtgtctggtatgtgttacgcagctgcctttcagttagctcttgcccgggagtgcatcaagatgagagtgacccagtgaaaccagaaactgtcattgagtagcaggatgggaaagcaatgtctagggaccaggatccctttgtcagtttttcctttttcctctcctccggcccctcccaggccttctctgagggagaagaggaagggctatgcaaatgagcacccttttcttatataggggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctg

SEQ ID NO: 1727 - DNA, 4385 bp, Homo sapiens; identical to SEQ ID NO: 837

SEQ ID NO: 1728 - DNA, 1593 bp, Homo sapiens
tctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatttttggggggagagacacagatttttacactaatatatggacctagcttgaggcaattttaatcccctgcactaggcaggtaataataaaggttgagttttccac

SEQ ID NO: 1729 - DNA, 720 bp, Homo sapiens
atgcagaccttcccagttgctggggcgctggaccctgctatactggacacaagcagcccccaagccctctacacggtcctcttaatagtgctggtcatgatgagcttggtgtttggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcacaccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtt

SEQ ID NO: 1730 - DNA, 3720 bp, Homo sapiens
gtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 1731 - DNA, 3720 bp, Homo sapiens; identical to SEQ ID NO: 1374

SEQ ID NO: 1732 - DNA, 1611 bp, Homo sapiens
tacttaggaagcctgtggtgagaacaacaacagtgcctgagaatcccacggctctggggaagtgagccccgaggatgaggctgctcgcctggctgattttcctggctaactggggaggtgccagggctgaaccagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggacatggtgacctacttcatgaacctgagccaggcgaatgctcaggggacgccgcgctgggagctcgagtaccagctgaccgaggcctatggggtgccggacgccagcgcccactccatgcacacagtgctggaccgcatcgctggcgaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccgcgcctgaggagtgaactgaaataggacaaccgaatcaggaagcgaagccccaggagctgcagccatccgtgatcgcgccactgcactccagcctgggtgacaaagccagactctctccaaaaacaaaccagaaacagaaaagaaatgacgacccaagacccccctacaagcatacttcttttgcgtattatgtttaactcacaaaacaaagctcatcatgcgtttg

SEQ ID NO: 1733 - DNA, 886 bp, Homo sapiens
gtcagggacactgagaggtgggtgtgtgcatgccacatttagcctcgctgtttacagccagttcaagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggaggggtgagtggctcagcttcctgggaatctgtttcctgagcaggggactggagggtggggagtgtggagaatgggcatccaggatcccttctcctgctgggaagctgtcactctgaggagggggctagccagcattgtctcctccatgccaatgagccagtggagagatacaagaagggacctgaaacctgcccaggcctgatgcagggatggggga

SEQ ID NO: 1734 - DNA, 886 bp, Homo sapiens; identical to SEQ ID NO: 1712

SEQ ID NO: 1735 - DNA, 568 bp, Homo sapiens
aagtttggttcttgggggctagacaagtttcttccccggtggggcggctgaacactcttcccaagggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttat

SEQ ID NO: 1736 - DNA, 1446 bp, Homo sapiens
gtccgctccgtccgcccttagacctgttgcccagcatccctgcagttcgcggtacagtctctagtagagcgcgtgtatagaggcagagaggagtgaagtccacagttcctctcctccaagaggtagaaggggcgcggggaaacgacctggtatcggttttccgcttgctgatcaagagctccctttaatgccgcacgcaggccggcgcccctcactgataaacgattggggctgggcctcggcctggagggcgttcgtcctctcagtgccctcagctcgtaaaggaggaaaccgaggcgtggggttgggcgagaacccaggggtcctcctgcacccccgccgccgtgtgtctcgtgtccagcgctggctggagcgcctcagccctggcgcggtgtagtcgtgagctggaacttctgacactgccccttccttccccgtccagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataacgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggt

SEQ ID NO: 1737 - DNA, 720 bp, Homo sapiens; identical to SEQ ID NO: 814

SEQ ID NO: 1738 - DNA, 720 bp, Homo sapiens; identical to SEQ ID NO: 814

SEQ ID NO: 1739 - DNA, 1593 bp, Homo sapiens; identical to SEQ ID NO: 674

SEQ ID NO: 1740 - DNA, 2305 bp, Homo sapiens; identical to SEQ ID NO: 1383

SEQ ID NO: 1741 - DNA, 1593 bp, Homo sapiens
tctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactctgctccctgtgtccccaatggctctgcgttgctgctctccaatccagcctaccgcctccttctggccacttacgcccgtccccctcgaggcccgggcccccccacacccgcctgggccaaacccaccaacacccaggggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatttttggggggagagacacagatttttacactaatatatggacctagcttgaggcaattttaatcccctgcactaggcaggtaataataaaggttgagttttccac

SEQ ID NO: 1742 - DNA, 2942 bp, Homo sapiens; identical to SEQ ID NO: 810

SEQ ID NO: 1743 - DNA, 3720 bp, Homo sapiens; identical to SEQ ID NO: 1374

SEQ ID NO: 1744 - DNA, 3949 bp, Homo sapiens; identical to SEQ ID NO: 830

SEQ ID NO: 1745 - DNA, 4013 bp, Homo sapiens
atgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 1746 - DNA, 720 bp, Homo sapiens; identical to SEQ ID NO: 814

SEQ ID NO: 1747 - DNA, 1347 bp, Homo sapiens
tctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactccgctccctgtgtccccaatggctctggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatttttggggggagagacacagatttttacactaatatatggacctagcttgaggcaattttaatcccctgcactaggcaggtaataataaaggttgagttttccac

SEQ ID NO: 1748 - DNA, 1452 bp, Homo sapiens
tcatgactacacagttaagggtcgtccatctgcttccccttctcctagcctgctttgtgcaaacaagtcccaagcaggagaagatgaagatggattgccacaaagacgagaaaggcaccatctatgactatgaggccatcgcacttaataagaatgaatatgtttccttcaagcagtatgtgggcaagcacatcctcttcgtcaacgtggccacctactgtggtctgacagcgcaatatcctgaactaaatgcactccaggaggagctgaagccctatggtctagttgtgttgggctttccctgcaaccaatttggaaagcaagaaccaggagataacaaagagattcttcctgggctcaagtatgtccgtccagggggaggatttgtacctagtttccagctttttgagaaaggggatgtgaatggtgaaaaagaacagaaagtcttcagtttcttgaagcactcctgtcctcatccctctgagattttgggcacattcaaatctatatcctgggaccctgtaaaggtccatgacatccgttggaactttgaaaagttcctggtggggcctgatggaatccctgtcatgcgctggtcccaccgggctacggtcagctcagtcaagacagacatcctggcgtacttgaagcaattcaaaaccaaataggaaggtggagttaagggcaggagcaaccctacttctcacctaatgacttgctctccccacccctccaaaaaaaaggaatacccatcttctcaccacactctcttcctgcatgggctccacctgagtaaatcaccgccacatactgccagaattcccactctccacaaactagatttatatttggaaggctactgctcttttgcctctcaagagtatgtgggtgaagactgaaacaaatggaaacctaaaatccccagacctctgttacaggttgaatcattcatatccaccagagggaaatcatccttccacgacaatggttcagtcggccatcacatcctgaagaacattcctagacattctgactcttccatctctctctaccctggaggtgtagaaatagcaatggggtcacagtcacacaatttaggttccacttcataacattttttgtctcctaggacaaacgtgtatcatcagtttccaactgttttggctcagttttcatccatgacacctccccctaccagccattctcctgtgggagcaagaacattgcttcaaaagaagagagggcatctccatgcttgtgggacccaaaacctatctctggccctacaaaagttttcctaattgtctgatctttagtgcattcaggttatggcacctggagaggaatgccctttatcttttgaaggatgggatttcccatctcaaccctggattcctcaccttcagaacgagccctgccactgtctccaataaaatgttttctgcagcatcg

SEQ ID NO: 1749 - DNA, 720 bp, Homo sapiens; identical to SEQ ID NO: 1729

SEQ ID NO: 1750 - DNA, 4385 bp, Homo sapiens; identical to SEQ ID NO: 837

SEQ ID NO: 1751 - DNA, 4385 bp, Homo sapiens
ccctctcttccccccgccctgccttcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacactgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggc

SEQ ID NO: 1752 - DNA, 886 bp, Homo sapiens; identical to SEQ ID NO: 1712

SEQ ID NO: 1753 - DNA, 2309 bp, Homo sapiens
atccgccccctgcctcatccaggcttcgccccagtcagtctccggcagcttctcgcggcttcgcaagccccttcccgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaattgtccagctttgttgctcattttcaattaaggctaaagtgttcaacatgagaaaatgtgatacatttgatacagtgtggggtgggagtggatgggcagctcttggtggtactggaccttccacaaggctgtgtccacccagaatccatgctggcaggagggaggcagaggtatcaaaccaaacctctcaccaagcggcccaggaggggcagctgttcctctcgtgacagcacaggcccatgagacagtgtcttctttttgaggggagctggtccgggtctagttcacttcaccaagaag

SEQ ID NO: 1754 - DNA, 2305 bp, Homo sapiens; identical to SEQ ID NO: 1383

SEQ ID NO: 1755 - DNA, 1334 bp, Homo sapiens
tcatgactacacagttaagggtcgtccatctgcttccccttctcctagcctgctttgtgcaaacaagtcccaagcaggagaagatgaagatggattgccacaaagacgagaaaggcaccatctatgactatgaggccatcgcacttaataagaatgaatatgtttccttcaagcagtatgtgggcaagcacatcctcttcgtcaacgtggccacctactgtggtctgacagcgcaatatcctggtatgtccgtccagggggaggatttgtacctagtttccagctttttgagaaaggggatgtgaatggtgaaaaagaacagaaagtcttcagtttcttgaagcactcctgtcctcatccctctgagattttgggcacattcaaatctatatcctgggaccctgtaaaggtccatgacatccgttggaactttgaaaagttcctggtggggcctgatggaatccctgtcatgcgctggtcccaccgggctacggtcagctcagtcaagacagacatcctggcgtacttgaagcaattcaaaaccaaataggaaggtggagttaagggcaggagcaaccctacttctcacctaatgacttgctctccccacccctccaaaaaaaaggaatacccatcttctcaccacactctcttcctgcatgggctccacctgagtaaatcaccgccacatactgccagaattcccactctccacaaactagatttatatttggaaggctactgctcttttgcctctcaagagtatgtgggtgaagactgaaacaaatggaaacctaaaatccccagacctctgttacaggttgaatcattcatatccaccagagggaaatcatccttccacgacaatggttcagtcggccatcacatcctgaagaacattcctagacattctgactcttccatctctctctaccctggaggtgtagaaatagcaatggggtcacagtcacacaatttaggttccacttcataacattttttgtctcctaggacaaacgtgtatcatcagtttccaactgttttggctcagttttcatccatgacacctccccctaccagccattctcctgtgggagcaagaacattgcttcaaaagaagagagggcatctccatgcttgtgggacccaaaacctatctctggccctacaaaagttttcctaattgtctgatctttagtgcattcaggttatggcacctggagaggaatgccctttatcttttgaaggatgggatttcccatctcaaccctggattcctcaccttcagaacgagccctgccactgtctccaataaaatgttttctgcagcatcg

SEQ ID NO: 1756 - DNA, 790 bp, Homo sapiens
acagccattggtcaggggcaaataccactagctctgcatcctcagtcactttgtgccatttcatcaggtcagagccaaagcttgaaaaatgaagacattagcaggacttgttctgggacttgtcatctttgatgctgctgtgactgccccaactctagagtccatcaactatgactcagaaacctatgatgccaccttagaagacctggataatttgtacaactatgaaaacatacctgttgataaagttgagattgaaatagccacagtgatgccttcagggaacagagagctcctcactccacccccacagcctgagaaggcccaggaagaggaagaggaggaggaatctactcccaggctgattgatggctcttctccccaggagcctgaattcacaggggttctggggccacacacaaatgaagactttccaacctgtcttttgtgtacttgtataagtaccaccgtgtactgtgatgaccatgaacttgatgctattcctccgctgccaaagaacaccgcttatttctattcccgctttaacagaattaaaaagatcaacaaaaatgactttgcaagcctaagtgatttaaaaaggattgatctgacatcaaatttaatatctgagattgatgaagatgcattccgaaaactgcctcaacttcgagagcttgtcctgcgtgacaacaaaataaggcagctcccagaattgccaaccactttgacatttattgatattagcaacaatagacttggaaggaaagggataaagcaagaagcatttaaa

SEQ ID NO: 1757 - DNA, 2942 bp, Homo sapiens; identical to SEQ ID NO: 810

SEQ ID NO: 1758 - DNA, 3949 bp, Homo sapiens; identical to SEQ ID NO: 830

SEQ ID NO: 1759 - DNA, 4385 bp, Homo sapiens; identical to SEQ ID NO: 837

SEQ ID NO: 1760 - DNA, 1347 bp, Homo sapiens; identical to SEQ ID NO: 1414

SEQ ID NO: 1761 - DNA, 2305 bp, Homo sapiens; identical to SEQ ID NO: 1383

SEQ ID NO: 1762 - DNA, 5268 bp, Homo sapiens
gacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccagctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtc

SEQ ID NO: 1763 - DNA, 1123 bp, Homo sapiens
cgtctgtagagatatcatgaacttcaacttagctttggtactttcttccctgaagacagagggcagaactctgagttccagaaccattttcaactgtattggggaccaatcacttgactctattcttgtctctctgacagatgacgctacactctcctctgaataatggacaccatttctaaaactgaatcctgctactaaaataattcagatgatatatttttccaattctacaatcttgctttgttttatttagttgttttctctctctcttcccagttttccagagactggagctaaactgggctttcaacatcatcatgaagtttatcctcctctgggctctcttgaatctgactgttgctttggcctttaatccagattacacagtcagctccactcccccttacttggtctatttgaaatctgactacttgccctgcgctggagtcctgatccacccgctttgggtgatcacagctgcacactgcaatttaccaaagcttcgggtgatattgggggttacaatcccagcagactctaatgaaaagcatctgcaagtgattggctatgagaagatgattcatcatccacacttctcagtcacttctattgatcatgacatcatgctaatcaagctgaaaacagaggctgaactcaatgactatgtgaaattagccaacctgccctaccaaactatctctgaaaataccatgtgctctgtctctacctggagctacaatgtgtgtgatatctacaaagagcccgattcactgcaaactgtgaacatctctgtaatctccaagcctcagtgtcgcgatgcctataaaacctacaacatcacggaaaatatgctgtgtgtgggcattgtgccaggaaggaggcagccctgcaaggaagtttctgctgccccggcaatctgcaatgggatgcttcaaggaatcctgtcttttgcggatggatgtgttttgagagccgatgttggcatctatgccaaaattttttactatataccctggattgaaaatgtaatccaaaataactgagctgtggcagttgtggaccatatgacacagcttgtccccatcgttcacctttagaattaaatataaattaactcctc

SEQ ID NO: 1764 - DNA, 3720 bp, Homo sapiens
gtcttcccctcgtgggccctgagcgggactgcagccagccccctggggagccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 1765 - DNA, 2516 bp, Homo sapiens
gggggctagacaagtttcttccccggtggggcggctgaacactcttcccaagtacctgctttgggtccaagtttcctacctatgtctctagtctgtagggatttcttgatttctaactcactattttcaccaatcctggggaaaatatgtatcgacctaaggttaaattccacctggcccaggagcctcctttggaaaccaggaagccgggaatctcgttgcaaaggaatcctgggcctcagaggagtcgttgcctctgcctcatagcataccccgacactgtctctgttttgggatgcagggttctgtttctgtctttttgagaagttcctggtttaattcactctcccatgataaactgttgtgtctggggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 1766 - DNA, 3949 bp, Homo sapiens
gtcttcccctcgtgggccctgagcgggactgcagccagccccctggggagccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 1767 - DNA, 660 bp, Homo sapiens
cagaagacggggactaggagcgctctgccgacgtcagcttttgtctccagtattttcgggggctggtggacgcgtgggcgatagggtgctgtccttggggtgctgtgtatatgggatgatgacgcttatcagcattatctagtcctttccaccccgaaattcgccccgattaaagactgtgttgcattatcagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaata

SEQ ID NO: 1768 - DNA, 3047 bp, Homo sapiens
gagccccgggaggaggtgctcctgtgcagccccactgagtcagctcatctatcgcctgccctccacctggccagtccctgcgggcatctaactgctaagcctccgctcagccaacacccagttggtcagtctggtcacagtccagcaaaaagagggactgccactctaacccaccagtgacaccactcttcccggctggatggtcaattagctctggcatgagagaatgtcactgccgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgca

SEQ ID NO: 1769 - DNA, 574 bp, Homo sapiens
ctctgccctttctgagcccgagggactgccacctccactgtgtgcacactcagctacgggacacagtaagtaccgatgccgcaaagggaggtccccagggcttgagggcatgtgaggcgaggagaggatggactctagagttttggggtttggggtctgcaaagctctgaaggagtctcatctctgcagtttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagat

SEQ ID NO: 1770 - DNA, 1136 bp, Homo sapiens
gctctacctcttggacttccaacttctgtgagtcaacatagtgcctcttgcatttaagaaacatctcatcacactcttatcagcattgagtttaaatttcaattagtgagaactgaggaaaaaccaagaagcctgcattccacagtgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 1771 - DNA, 467 bp, Homo sapiens
ctttttgcacacacacgaatacaaagagccatacgaccttcggttttaatttggtttaacctttagtttcaggtttagctgtgcctcccagtgactataatgacaaggaagctgtaaatgtatttgagttaagcttttgcgagaagcaaagtgacagcatagctgttcaaacattcctgttgaattttggatccacccttaaggagcttgagaaatgaagataaggggccccacgggtgatttctctgggctcctggctggaagattcaggacagctagtttccattacagaggctcatggcccagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttct

SEQ ID NO: 1772 - DNA, 852 bp, Homo sapiens
ctttttgcacacacacgaatacaaagagccatacgaccttcggtttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcct

SEQ ID NO: 1773 - DNA, 1172 bp, Homo sapiens
gctctacctcttggacttccaacttctgtgagtcaacatagtgcctcttgcatttaagaaacatctcatcacactcttatcagcattgagtttaaatttcaattagtgagaactgaggaaaaaccaagaagcctgcattccacagatcaagatgttgcagaggctccgcgttcttgtgagatgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 1774 - DNA, 2071 bp, Homo sapiens
aagacagagctgagacagccacccagggggtccactccaggacagactgtgcctgtgggctcacagggaagaggtcatgggcgaacagagtgaaggcaaccatctataagtgccagagagccctcaccagagaccaaccctgacggcaccttgaccttggatttccagcgtccagaactccacataattgggccccaaagccatgaagaaggaagaggaaatgtcttaaaggttgtcgatggacagtgtttgctgaacatcaaaatcactttccagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgta

SEQ ID NO: 1775 - DNA, 1101 bp, Homo sapiens
actcatctcatggcttcttccatcttaggtggccgtttttcagctgagtttcattttctagttctctgtggtaattctgttgtcattgttgtctccatagaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgatactggcgtgcagattcttctctctctatctctctctctgtgtggggggagggtggggagggtgtaaaacaaactgaatttcatcctagctcagctataaagccaagaaacagaatccacctaactaggcagaatta

SEQ ID NO: 1776 - DNA, 585 bp, Homo sapiens
ctttttgcacacacacgaatacaaagagccatacgaccttcggaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaagg

SEQ ID NO: 1777 - DNA, 588 bp, Homo sapiens
ctttttgcacacacacgaatacaaagagccatacgaccttcgggcaaagtgacagcatagctgttcaaacattcctgttgaattttggatccacccttaaggagcttgagaaatgaagataaggggccccacgggtgatttctctgggctcctggctggaagattcaggacagctagtttccattacagaggctcatggcccagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccag

SEQ ID NO: 1778 - DNA, 441 bp, Homo sapiens
gagtcctcctttttgcacacacacgaatacaaagagccatacgaccttcgggtatcctttttccattttttttcctccttaatcttgtgtgtgttttcaaattttttaaaaatagagatctgtagcagtgttgggaatgtcttactaccctatcagttaatcctatacattgctcaaggctcaactggaagcttttcttcttttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttct

SEQ ID NO: 1779 - DNA, 586 bp, Homo sapiens
aagacagagctgagacagccacccagggggtccactccaggacagactgtgccaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatc

SEQ ID NO: 1780 - DNA, 1462 bp, Homo sapiens
cgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaagatccccataccgagtgtgcctacgttccagccgtctacacctgtccctgagcgcctggaagctgtgcagcgctacatcagagagctgcagtacaatcacacagggacacagttctttgaaattaagaagagcagacctctgacagggctgatggacctggccaaggaaatgaccaaagaggccctgccaatcaaatgcctggaagccgtgatcctgggaatgtatccttcctcacctgaaggggaggggtccgggcttctctgggcctcagcttcctgctctgaaagtgagggtggggtaggttgaatgggctccagggctctcccatatgcagtcatctgcttggccccaagatggagaagcaccccactaaagtggaagaaccccccaaaatggaggagccccgaggtcccagtaccccacatctcagttgctaccttcccaggcttactgggcagctcttttttgagtcacgtggatacagggaccgttttctgaaccccaaatcagggcacagtgtctcacaaagacagttgtaccatttccaagaactagacagtctgggaggcacagttggaatgcccagatgttggcatttccagaacatgttgatttctggacgagatattaaagcaaaactgccttaaaaaaaaaaaaaac

SEQ ID NO: 1781 - DNA, 2210 bp, Homo sapiens
tttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaaca

SEQ ID NO: 1782 - DNA, 4090 bp, Homo sapiens
gtgttctctgcggtgcaccgaggcgcacccggctgtcctgttgcgggtctcctggtcacctgtgggccatagggagagacgcgcccacacactctcgcccgcgcccaggacagctgcgggagccccgggccgctctaacccaatgcgtctcccgcaggctgagatgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgaggctacaaccagatcctcatagttcccatgggtgccaccagcatcctcatcgacgaggctgctgccagcaggaacttcctggctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgcctaccccgtgcggtgcctgctgcccagtgcccatggctcttgcgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaacgggctacctgtgcaggctgatggccaccgtgtccaccagtccccagatggcacgctgctcatttacaacttgcgggccagggatgagggctcctacacgtgcagtgcctaccaggggagccaggcagtcagccgcagcaccgaggtgaaggtggtctcaccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctgg

SEQ ID NO: 1783 - DNA, 533 bp, Homo sapiens
gtgcacactcagctacgggacacatttcaggtatccaaggcagcagaggtgagtgggtcccccgagctctgtgaccttatgctccacactaactctggcagagcctccgtttcctcatagggcaaggccagcagtgctgatggtcccaggcatgtagctggtctgagttcatagaaggaccacagcgccctgccatgtgccaaaccaggacaccagagtgaaggccagaagctcacatggaagcagcttagttccctgaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagc

SEQ ID NO: 1784 - DNA, 1113 bp, Homo sapiens
agtgacaaatgctggctgcaatccagccagccctctgccctttctgagcccgagggactgccacctccactgtgtgcacactcagctacgggacacatttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggtactttcagact

SEQ ID NO: 1785 - DNA, 527 bp, Homo sapiens
gtcactaattctgagctatggcatttcaatcctaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagct

SEQ ID NO: 1786 - DNA, 2211 bp, Homo sapiens
agtgacaaatgctggctgcaatccagccagccctctgccctttctgagcccgagggactgccacctccactgtgtgcacactcagctacgggacacaaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaaca

SEQ ID NO: 1787 - DNA, 1101 bp, Homo sapiens
gctctacctcttggacttccaacttctgtgagtcaacatagtgcctcttgcatttaagaaatttcaattagtgagaactgaggaaaaaccaagaagcctgcattccacagtgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 1788 - DNA, 618 bp, Homo sapiens
ctttttgcacacacacgaatacaaagagccatacgaccttcgggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgc

SEQ ID NO: 1789 - DNA, 2668 bp, Homo sapiens
gctctacctcttggacttccaacttctgtgagtcaacatagtgcctcttgcatttaagaaatttcaattagtgagaactgaggaaaaaccaagaagcctgcattccacagatcaagatgttgcagaggctccgcgttcttgtgagagtatgttccgagctctctgacctgtcaccatgggatcactcttttgaagagacttcctggaggacactgatgacagtgtgaaagcagggatgggaggaaaagcagggaggggagggacagtgtggcacatggccgccccagagtgcccattctcacatcgccattttaggcaactttttcttttctttcccattctctgcactcctatgctcaactttcctgtctctactttctgatgtgttccccaacacccacctttctttaattccatcattctctaacctttctacacacatatatacaaacttagtatccagcctagaacaggaggctgtccatctccatcactgatagatcaaggtctccaggtaatgactgttagagaatcactcaggttgccaccaagtaggacttcttttacaacgagcctggtaaggtaagaaaactcaggaggttgcttctgcaattaaataattggttcttcatggagcatggaccaatttgtcaaagcactctaggggctcaaattccgttttagcactggccatttcagtagtcattgtgtttgacagcctagagagagagatacagtctagccttaagaagggaaaccagactgatagaggccatagaatagcagctaaggacagatgtgtggaatttagacaaaaataggcttgaaccaggagtctgccggatctaatgtgagattttaagcaacttcccttcacggagagatgttaataactttacacttctttttgcaactttcattgttataataacaacaatgctaaaaataatatatttattatagggttgtttggatgatggtgataatgtacttagagtgcttagtctagtgcttggcacttaactcctcattatgctagctatgactgtgtatcattgtttttactttagggtgacttcaagaatgtatttatcccagctgctcaaacttgaaccttccttgaccccttccccaagggcatctatggtcaaataagggcaagaggagaaagaaagacatggttaaggaatttttcttatcaaagtggaatgttcgaaaggggagggtggctcttttcagagcaagttctcaactcctggaaagggaaaagatgcatttatttcagacgaaaggagcatgtgagcctcctctctgcaccctccctttctccccactgctgtcttgatttcctttctccttccctctctccttaatctctctcttgctccatttcttccttgtttccttttcttcctccttacctttatttctctccctttctcattctccttcctttcaccttttcttctcttaccacagctctagactgactgtaggcctagtaaggtcatttttgtcaataatttagaagtattcagatcgattatgagttggtaatttaaaaatggtccaaaatcttagagcccagaacagcaacatgtggcataactgtgccccacacaggaaatggaagcaagcacattatcacaatagaacatatcccgttatctcttttagtgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 1790 - DNA, 4282 bp, Homo sapiens
gcggtgcaccgaggcgcacccggctgtcctgttgcgggtctcctggtcacctgtgggccatagggagagacgcgcccacacactctcgcccgcgcccaggacagctgcgggagccccgggccgctctaacccaatgcgtctcccgcaggctgagatgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgaggctacaaccagatcctcatagttcccatgggtgccaccagcatcctcatcgacgaggctgctgccagcaggaacttcctggctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaacgggctacctgtgcaggctgatggccaccgtgtccaccagtccccagatggcacgctgctcatttacaacttgcgggccagggatgagggctcctacacgtgcagtgcctaccaggggagccaggcagtcagccgcagcaccgaggtgaaggtggtctcaccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagac

SEQ ID NO: 1791 - DNA, 568 bp, Homo sapiens
ctttttgcacacacacgaatacaaagagccatacgaccttcgggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtcca

SEQ ID NO: 1792 - DNA, 1341 bp, Homo sapiens
acacaactggaacccatctccaggaacaaacagctggaacccatctcccgttgaagggaaactgccagatttttgtaagattcttcctcctgggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacctgagaa

SEQ ID NO: 1793 - DNA, 618 bp, Homo sapiens
acactcagctacgggacacagtaagtaccgatgccgcaaagggaggtccccagggcttgagggcatgtgaggcgaggagaggatggactctagagttttggggtttggggtctgcaaagctctgaaggagtctcatctctgcagtttcaggtatccaaggcagcagagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacacct

SEQ ID NO: 1794 - DNA, 1131 bp, Homo sapiens
attccaaattcgggaaccaccagaaaggctggcctctcttcaacatgggatcttctggacttttgagcctcctggtgctattcgtcctcttagcgaatgtccagggacctggtctgactgattggttatttcccaggagatgtcccaaaatcagagaagaatgtgaattccaagaaagggatgtgtgtacaaaggacagacaatgccaggacaacaagaagtgttgtgtcttcagctgcggaaaaaaatgtttagatctcaaacaagatgtatgcgaaatgccaaaagaaactggcccctgcctggcttattttcttcattggtggtatgacaagaaagataatacttgctccatgtttgtctatggtggctgccagggaaacaataacaacttccaatccaaagccaactgcctgaacacctgcaagaataaacagccgtgtcccaaaatcaaagtggaatgcgaagtggaagaaatagaccagtgtaccaaacccagagattgcccagaaaacatgaagtgttgcccgttcagccgtggaaagaaatgtttagacttcagaaaggcctctctgtctacataaatccaggatgccttccctgaccaccttagaccgcctacactctttcttctctgcccatattattgagctctaaagaagatcatcaaggaccattcgttcattctattcattcaacaaatattgattggtgcccctgacacccatgatgggttccacttgctcattgtggccaggaaggtcagaaaagtttttctgggaaagagatccatgatttaagatctgaaagatgagtacttagaccaaaaatgggaagaaatagcctttcaggccagataataggatgtgcaaaggctctgtggcaggaggcaggatgttcaggtctagaaaggctagaaagcagagagtgagcaagagacaagaaacaggaaactggtagtgtatattcagggcaacttgaatctgtattcccaagtggccatcctcaagttttggggtcaaataaatgccctacttaatgatattttctgaatcttgttactttaggttgacatacctttcaagacaataactaggttttcagtgctttgataaaacctcaaatgtgtgg

SEQ ID NO: 1795 - DNA, 1907 bp, Homo sapiens
tttttccacccccttttgtcaactactgaaaaaaagtctccgttaaatttgaaacacaaactgtctcgcgatgggctgtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacctgagaa

SEQ ID NO: 1796 - DNA, 886 bp, Homo sapiens
cagtgacctagagcaggcatggaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactga

SEQ ID NO: 1797 - DNA, 571 bp, Homo sapiens
acacacgaatacaaagagccatacgaccttcggagactgggtcttgctatgctgccgaggttggtctcaaactcctgggctcaagcgatcctcctcctcccaaagtgctgggattacaggcatgagccaccatgcccagccatgaatgtcttactaccctatcagttaatcctatacattgctcaaggctcaactggaagcttttcttcttttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactgg

SEQ ID NO: 1798 - DNA, 462 bp, Homo sapiens
aaaatgtcggctggataggaggtgctcagtaagtggcagcttctgttgttttctgtgcctggagtcttgggcctttagaaatcaggaacaatgatccaatattatcggcttccgtgagataagggcatcttgcctggaggctgccacccaggccggtcatggcagctgctcatgaaggacagtaacaatttggcagtttgttaaatgaacaaaatgtagaaataaagtaagcagaatttttagtttttctgaaggtagggcttttggccagatatgcagcaataaaagagcaaactgcttccttgggccagtgtccttgctcatagatcaggaaaccgaagcatgaagaatacaggcggcagatgcctgaagaacaaagaacagccaccatgcagctcttcctcctcttgtgcctggtgcttctcagccctcagggggcctcccttcaccgccaccaccccc

SEQ ID NO: 1799 - DNA, 1212 bp, Homo sapiens
gctctacctcttggacttccaacttctgtgagtcaacatagtgcctcttgcatttaagaaatttcaattagtgagaactgaggaaaaaccaagaagcctgcattccacagatcaagatgttgcagaggctccgcgttcttgtgagagtatgttccgagctctctgacctgtcaccatgggatcactcttttgaagagacttcctggaggacactgatgacatgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 1800 - DNA, 499 bp, Homo sapiens
ctttttgcacacacacgaatacaaagagccatacgaccttcgggtatcctttttccattttttttcctccttaatcttgtgtgtgttttcaaattttttaaaaatagagatctgtagcagtgttggggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccct

SEQ ID NO: 1801 - DNA, 631 bp, Homo sapiens
ggggttggagcaggaggaatctgactgtcctttgctactttctatcttcccttactcaacagcagtcaaagccaaagatgcgaagtcactcttacctctgatgataataatggtgataattttcttggtgcttctgttctgggaaaatgaggtgaatgatgaagcagtgatgtcaactttagaacacttgcatgtggactaccctcagaatgacgttcccgttcctgcaaggtactgcaaccacatgatcatacaaagagttatcagggaacctgaccacacttgtaaaaaggagcatgtcttcatccatgagaggcctcgaaaaatcaatggtatttgcatttctcccaagaaggttgcttgccaaaacctttcggccattttctgctttcagagtgagacaaagttcaaaatgacagtctgtcagctcattgaaggcacaagataccctgcctgcaggtaccactattcccccacagaggggtttgttcttgtcacttgtgatgacttgaggccagatagtttccttggctatgttaaataactcaagatcagctcccgagtctgagatctcttctctcaatggcattggagctggctgtgcctgaggcagacctggaccgtggacatg

SEQ ID NO: 1802 - DNA, 829 bp, Homo sapiens
gacaaatgctggctgcaatccagccagccctctgccctttctgagcccgagggactgccacctccactgtgtgcacactcagctacgggacacatttcaggtatccaaggcagcagagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgc

SEQ ID NO: 1803 - DNA, 1626 bp, Homo sapiens
atggcaaaatttggcgttcacagaatccttcttctggctatttctctgacaaagtgtctggagagtacaaaactgctggcagaccttaaaaaatgtggtgacttggaatgtgaagctttaataaacagagtctcagccatgagagattatagaggacctgactgccgatacctgaacttcactaagggagaagagatatctgtttatgttaaacttgcaggagaaagggaagatttgtgggcaggaaaaggaaaggagtttggatattttcccagagatgcagtccagattgaagaggtgttcatatctgaggaaattcagatgtcaacgaaagaatctgactttctttgtcttcttggagtaagttacacatttgacaatgaagatagtgaattaaacggtgattatggtgaaaatatatatccttatgaagaagataaagatgaaaaatctagtatatatgaaagtgattttcagatagaacctggattttatgcaacttatgaaagtactttgtttgaagaccaagttccagcattagaggctcctgaagatatcggaagtaccagtgaatcaaaagactgggaagaagtagttgttgaaagtatggaacaggatcgtattccagaagtgcatgtcccaccatcttcagctgtgtctggagtcaaagaatggtttggattgggaggagaacaagctgaagagaaggcttttgaatcagttattgaacctgtacaagaaagctcatttcggagtagaaaaatagcagtggaagatgagaatgacctagaggaattaaataatggtgagcctcaaacagaacatcagcaagaatctgaatcagaaattgattcagtgccaaagacacagtctgaactagcatctgagtcagagcacattcccaaacctcaatccactggttggtttggtggaggatttacaagttatttaggttttggagatgaggatacagggcttgaattaatagctgaagaaagcaatccaccactacaagattttcccaattccatatcatctgataaagaagccacagttccatgtacagaaatattaacagaaaaaaaagacacaatcactaatgatagcttgagtctcaagccaagttggtttgattttggttttgctatactaggctttgcatatgccaaggaagataaaattatgttagatgacaggaaaaatgaagaagatggtggggcagatgaacatgaacatcctctaacaagtgaattagaccctgaaaaagaacaagaaatagaaacgataaaaattatagaaacagaagatcaaatagacaagaaaccagtctcagaaaaaacagacgaatctgatactataccatatttgaaaaagttcttgtataattttgacaacccttggaacttccagaacattccaaaggaaacagaattgccatttcccaaacagatactggatcaaaataatgtaattgaaaatgaagaaactggagaattttccattgataattatcccacagataatacaaaagttatgatattcaaaagttcatacagtctgtcaggttggtatgaaaatatttacattagaatttattttatttttaaacataatttatttttataa

SEQ ID NO: 1804 - DNA, 1497 bp, Homo sapiens
ggccttactcttccaagaggccatggaagtataaataataaagcaagaaaggcagatgcatttggctggctcagtggacttctgaatgtactgtgagtatgagaccttcccttccaaaagatccggtgcttcttgtctattccacacgaagcttgcttcagatcgagggaggatgtagcactgtccacaggtctactactcaacaggatattcttcaaggaaaatgaaccccacactaggcctggccatttttctggctgttctcctcacggtgaaaggtcttctaaagccgagcttctcaccaaggaattataaagctttgagcgaggtccaaggatggaagcaaaggatggcagccaaggagcttgcaaggcagaacatggacttaggctttaagctgctcaagaagctggccttttacaaccctggcaggaacatcttcctatcccccttgagcatctctacagctttctccatgctgtgcctgggtgcccaggacagcaccctggacgagatcaagcaggggttcaacttcagaaagatgccagaaaaagatcttcatgagggcttccattacatcatccacgagctgacccagaagacccaggacctcaaactgagcattgggaacacgctgttcattgaccagaggctgcagccacagcgtaagtttttggaagatgccaagaacttttacagtgccgaaaccatccttaccaactttcagaatttggaaatggctcagaagcagatcaatgactttatcagtcaaaaaacccatgggaaaattaacaacctgatcgagaatatagaccccggcactgtgatgcttcttgcaaattatattttctttcgagccaggtggaaacatgagtttgatccaaatgtaactaaagaggaagatttctttctggagaaaaacagttcagtcaaggtgcccatgatgttccgtagtggcatataccaagttggctatgacgataagctctcttgcaccatcctggaaataccctaccagaaaaatatcacagccatcttcatccttcctgatgagggcaagctgaagcacttggagaagggattgcaggtggacactttctccagatggaaaacattactgtcacgcagggtcgtagacgtgtctgtacccagactccacatgacgggcaccttcgacctgaagaagactctctcctacataggtgtctccaaaatctttgaggaacatggtgatctcaccaagatcgcccctcatcgcagcctgaaagtgggcgaggctgtgcacaaggctgagctgaagatggatgagaggggtacggaaggggccgctggcaccggagcacagactctgcccatggagacaccactcgtcgtcaagatagacaaaccctatctgctgctgatttacagcgagaaaataccttccgtgctcttcctgggaaagattgttaaccctattggaaaataaaggagaattcctgcttgccacagaccccg

SEQ ID NO: 1805 - DNA, 2703 bp, Homo sapiens
gctctacctcttggacttccaacttctgtgagtcaacatagtgcctcttgcatttaagaaacatctcatcacactcttatcagcattgagtttaaatttcaattagtgagaactgaggaaaaaccaagaagcctgcattccacagatcaagatgttgcagaggctccgcgttcttgtgagagtatgttccgagctctctgacctgtcaccatgggatcactcttttgaagagacttcctggaggacactgatgacagtgtgaaagcagggatgggaggaaaagcagggaggggagggacagtgtggcacatggccgccccagagtgcccattctcacatcgccattttaggcaactttttcttttctttcccattctctgcactcctatgctcaactttcctgtctctactttctgatgtgttccccaacacccacctttctttaattccatcattctctaacctttctacacacatatatacaaacttagtatccagcctagaacaggaggctgtccatctccatcactgatagatcaaggtctccaggtaatgactgttagagaatcactcaggttgccaccaagtaggacttcttttacaacgagcctggtaaggtaagaaaactcaggaggttgcttctgcaattaaataattggttcttcatggagcatggaccaatttgtcaaagcactctaggggctcaaattccgttttagcactggccatttcagtagtcattgtgtttgacagcctagagagagagatacagtctagccttaagaagggaaaccagactgatagaggccatagaatagcagctaaggacagatgtgtggaatttagacaaaaataggcttgaaccaggagtctgccggatctaatgtgagattttaagcaacttcccttcacggagagatgttaataactttacacttctttttgcaactttcattgttataataacaacaatgctaaaaataatatatttattatagggttgtttggatgatggtgataatgtacttagagtgcttagtctagtgcttggcacttaactcctcattatgctagctatgactgtgtatcattgtttttactttagggtgacttcaagaatgtatttatcccagctgctcaaacttgaaccttccttgaccccttccccaagggcatctatggtcaaataagggcaagaggagaaagaaagacatggttaaggaatttttcttatcaaagtggaatgttcgaaaggggagggtggctcttttcagagcaagttctcaactcctggaaagggaaaagatgcatttatttcagacgaaaggagcatgtgagcctcctctctgcaccctccctttctccccactgctgtcttgatttcctttctccttccctctctccttaatctctctcttgctccatttcttccttgtttccttttcttcctccttacctttatttctctccctttctcattctccttcctttcaccttttcttctcttaccacagctctagactgactgtaggcctagtaaggtcatttttgtcaataatttagaagtattcagatcgattatgagttggtaatttaaaaatggtccaaaatcttagagcccagaacagcaacatgtggcataactgtgccccacacaggaaatggaagcaagcacattatcacaatagaacatatcccgttatctcttttagtgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 1806 - DNA, 703 bp, Homo sapiens
cacaggctttggagagcactctctgtcctgatcttttcagttgagagacttcagctgttcattgctcatttggacttagttcaaggtcatgtcaaagaagaagaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaatacca

SEQ ID NO: 1807 - DNA, 1137 bp, Homo sapiens
gctctacctcttggacttccaacttctgtgagtcaacatagtgcctcttgcatttaagaaatttcaattagtgagaactgaggaaaaaccaagaagcctgcattccacagatcaagatgttgcagaggctccgcgttcttgtgagatgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 1808 - DNA, 681 bp, Homo sapiens
ggcatttcaatcctgtatgtgagagctagagactcatacagtgacctagagcaggcatggaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaa

SEQ ID NO: 1809 - DNA, 607 bp, Homo sapiens
acaatgcccaggacaagatcacaaagcatcatcctgttcaaaaggtcaacaggatcaaggttgagagaccctgaaataaggccatggggacaaaatgtcggctggataggaggtgctcaaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacact

SEQ ID NO: 1810 - DNA, 2596 bp, Homo sapiens
tcccccctcttaaaacacgatgcctcccaggatgctagtggcaccactgccactgcatttcctgttggcagcagtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgatgccaggacgcgctcccctccgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagagattatttgaatatattttgctgtataaggatggagtgatgtttcagattgaccaagccaccaagcagtgctcaaagatgaccctgacacagccctgggatcctcttgacattcctcaaaactccacctttgaagaccagtactccatcggggggcctcaggagcagatcaccgtccaggagtggtcggacagaaagtcagctagatcctatgaaacctggattggcatctatacagtcaaggattgctatcctgtccaggaaacctttaccataaactacagtgtgatattgtctacgcggttttttgacatccagctgggtattaaagacccctcggtgtttacccctccaagcacgtgccagatggcccaactggagaagatgagcgaagactgctcctggtgagcctgtgcatagggaagcggcagcatcggatgtcagccccctgcggccccagctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtggccatatgaactgactagatggctaatatggacactttgggtatttctaatgcctgttcagggctggttttctgcatgcacgggtatacacataatgcagtgccatgcacatagggaagggtcagtaagagaagtttgccttggcagcaagtatttattgttgacattattcagaattagtgataataaaaagcagagtgattttggtcaattttattattaattcttaaattccctgcagagaatgccccctttattgctgcaccagggttggcattgctcccactgagccctactccaccctgtccctgcactcccttggttgccaaaaaaatgataacttaaatcccttccagacttaagaattttatggcatggcccaattgatataaacatttagaaggaaatgaaaagctaaaataggaagtaattattcctctaaagaaacattttgagcaaggcagtttagagaatcctaatgtctacactggcatagcacgagccatgtaagcttcttttttttctatgcaagagtattgatgtatgtgctgaatcttcacagacttgtcaatacacaggcagtattctaaaatagcactgaacagggagtcaggagactattgtctcctaaacccaggactagagttccctcgtactgtcactcctttggtcattaaatgcactgggcttgcccgcactttggccttcctagaacactgcttcataacctctctgtctgacttctgcatctccttccaggtcagctcattcacaagagttgctcccaagcctggatgagttgcaccttgcatcttgagcatgcatttctcacaataattattaagctgtgtgataatttctgctttcaggacactcatccattatcttggctgtgagctccttgggtacgggtaccttgtatgtttacttttatatccctagcacaaagcaagtgcctggcacatagtcagtgccctaagtattcgtagagtgaagaatgccagcctctcttgtccctggtttccttatgtgttgaatgtggttgagtttgtccattgctagggagagacttccagtaataaaatttactattctagatgcttctactgttatgttttatctgcccatttatctttcttagttaccaggagaaatgtgtgacacctatattataatgaaaacaatctcattacttatagtttatctatattaaacaaatttaattgcattttaaagcattctttgatactgttgcttttgcaataaatatggataatcttggttataagggagttaaaacaatgctgtaataaataaagtgcttcatgtgatcaaaatc

SEQ ID NO: 1811 - DNA, 321 bp, Homo sapiens
ggtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctcttag

SEQ ID NO: 1812 - DNA, 1708 bp, Homo sapiens
gagttatcagaggtgagcccgtgctcttcagcggagaagatcccctacctggccgccggccactttctgtgggccgtggggtcctcaaggagacggcccttgggctcaggggctgcgtttccacacgcgcctttcccagggctcccgcgcccgttcctgcctggccgccggccgctccaacagcagcacaaggcgggactcagaaccggcgttcagggccgccagcggccgcgaggccctgagatgaggctccaaagaccccgacaggccccggcgggtgggaggcgcgcgccccggggcgggcggggctccccctaccggccagacccggggagaggcgcgcggaggctgcgaaggttccagaagggcggggagggggcgccgcgcgctgaccctccctgggcaccgctggggacgatggcgctgctcgccttgctgctggtcgtggccctaccgcgggtgtggacagacgccaacctgactgcgagacaacgagatccagaggactcccagcgaacggacgagggtgacaatagagtgtggtgtcatgtttgtgagagagaaaacactttcgagtgccagaacccaaggaggtgcaaatggacagagccatactgcgttatagcggccgtgaaaatatttccacgttttttcatggttgcgaagcagtgctccgctggttgtgcagcgatggagagacccaagccagaggagaagcggtttctcctggaagagcccatgcccttcttttacctcaagtgttgtaaaattcgctactgcaatttagaggggccacctatcaactcatcagtgttcaaagaatatgctgggagcatgggtgagagctgtggtgggctgtggctggccatcctcctgctgctggcctccattgcagccggcctcagcctgtcttgagccacgggactgccacagactgagccttccggagcatggactcgctccagaccgttgtcacctgttgcattaaacttgttttctgttgattacctcttggtttgacttcccagggtcttgggatgggagagtggggatcaggtgcagttggctcttaaccctcaagggttctttaactcacattcagaggaagtccagatctcctgagtagtgattttggtgacaagtttttctctttgaaatcaaaccttgtaactcatttattgctgatggccactcttttccttgactcccctctgcctctgagggcttcagtattgatggggagggaggcctaagtaccactcatggagagtatgtgctgagatgcttccgacctttcaggtgacgcaggaacactgggggagtctgaatgattggggtgaagacatccctggagtgaaggactcctcagcatggggggcagtggggcacacgttagggctgcccccattccagtggtggaggcgctgtggatggctgcttttcctcaacctttcctaccagattccaggaggcagaagataactaattgtgttgaagaaacttagacttcacccaccagctggcacaggtgcacagattcataaattcccacacgtgtgtgttcaacatctgaaacttaggccaagtagagagcatcagggtaaatggcgttcatttctctgttaagatgcagccatccatggggagctgagaaatcagactcaaagttccaccaaaaacaaatacaaggggacttcaaaagttcacg

SEQ ID NO: 1813 - DNA, 2844 bp, Homo sapiens
gcacgcacgcacgcacgccctcgggaagcgacgagtccgggacgcccagcgcgggcccggagcagggggaagggaagtgcggctcggtcggcgcgggtggagggggcgtgaggccgccctacggtggccgtcgagggacggcgctacggctcccacgctaggccaaacgcctccggcggccgcgcccgagagccccttcacctgcagggcgaccccagccggcgacgcgtgaaccacgccctcagccgccttgccagcgcccccagccgcgcgccccagcaccatgcggccgccctgcgcacggagccccgagggacaggggcacccgcaggcccggcccctagcaccgccggccggccccgaggtccgggacgccggcgccgccgcggagagggcaccgggccgacgcctccccccagggtcagctgcgggctcccaggcctaggcgcccatgacccctacgccaacagccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttgatgg

SEQ ID NO: 1814 - DNA, 2456 bp, Homo sapiens
atgtcggccccgccccgacggcgctgactcagtttcaccagaaaccagggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttacggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacgcggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctatcctctcttcctcttcccccaagattgagctctctgcccttgatcagccccaccctggcctagaccagcagacagagccaggagaagctcagctgcattccgcagcccccacccccaaggttctccaacatcacagcccagcccgcccactgggtaataaaagtggtttgtgga

SEQ ID NO: 1815 - DNA, 1970 bp, Homo sapiens
tctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaa

SEQ ID NO: 1816 - DNA, 984 bp, Homo sapiens
cccccagaacaagatgggagtcatggccatgctgatgctccccctgctgctgctgggaatcagcggcctcctcttcatttaccaagaggtgtccaggctgtggtcaaagtcagctgtgcagaacaaagtggtggtgatcaccgatgccatctcaggactgggcaaggagtgtgctcgggtgttccacacaggtggggcaaggctggtgctgtgtggaaagaactgggagaggctagagaacctatatgatgccttgatcagcgtggctgaccccagcaagacattcaccccaaagctggtcctgttggacctctcagacatcagctgtgtcccagatgtggcaaaagaagtcctggattgctatggctgtgtggacatcctcatcaacaatgccagtgtgaaggtgaaggggcctgcccataagatttctctggagctcgacaaaaagatcatggatgccaattactttggccccatcacattgacgaaagccctgcttcccaacatgatctcccggagaacaggccaaatcgtgttagtgaataatatccaagggaagtttggaatcccgttccgtacgacttacgctgcctccaagcacgcagccctgggcttctttgactgcctccgagccgaagtggaggaatacgatgttgtcatcagcaccgtgagcccgactttcatccggtcgtaccacgtgtatccagagcaaggaaactgggaagcttccatttggaaattctttttcaggaagctgacctacggcgtgcacccagtagaggtggcggaggaggtgatgcgcaccgtgcggaggaagaagcaagaggtgtttatggccaaccccatccccaaggccgccgtgtacgtccgcaccttcttcccggagttctttttcgccgtggtggcctgtggggtgaaggagaagctcaatgtcccggaggaggggtaactgcaggaggccaaatgggccaccccttggaaata

SEQ ID NO: 1817 - DNA, 1931 bp, Homo sapiens
gcaagatgtagctgtgtagtctccttccatagctgctctaagggggctggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagagacaaggatggagatctgaagactcaaattgaaaagctctggacagaagtcaatgccttgaaggaaattcaagccctgcagacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaataggtctttctccaatgtgtcctccaagcaagattcatcataacttataggttcatgatctctaagatcaagtaaaaatcataatttttacttattaaaaaattgcaacacaagatcaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttggaagtttagcgtatgtttgactaacaaaaattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattttttttttttcttcatgcctaccctttttttggaagtttccagccgcaatttgaaatgaaatgacaaggtgtatatttgatcaattttcattcccaccattgcattacaacctctaacttaaatgggtaaccctaaggcatatcaaagaagcagattgcatgataaacggaaacagaaaaaaagaacctacatttattttgctttagcatccttactctcaccttttatgagattgagagtggacttacatttccttttttacattttcgtatacttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtgttttgtgaacaatatcccactttgcaaactttaactacacatgcttggaattaagttttagctgttttcattgctcaataataaagcctgaattctgatc

SEQ ID NO: 1818 - DNA, 1553 bp, Homo sapiens
gtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 1819 - DNA, 1575 bp, Homo sapiens
gaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 1820 - DNA, 2033 bp, Homo sapiens
cccgactccgagctgtccccgctcccggcgcggcgctccgctctcagccacctcacggctgccaggagtgcgcgggagtttgccccggagcgcggggaagtttcctccgaagctgcgctcctggaacagcagcacctgcaagcgcccggcagcggcccgcgaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcaaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaag

SEQ ID NO: 1821 - DNA, 1687 bp, Homo sapiens
ctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggctggagtgcaatggcaaatctcggcacactacaacttctgcctcccaggttcaagcgattctcctgcctcagcctcccaaatatctggattacaggcatgcctgtgccggccacctctgtcccctgtccctctgcaggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctag

SEQ ID NO: 1822 - DNA, 1540 bp, Homo sapiens
gggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 1823 - DNA, 3017 bp, Homo sapiens
catcccctgccctggctgcaaccatgagggtcttggcctgcctccttgcggccctggtggggatccaggctgttgagcgcctgcgcctggccgatggcccccatgggtgcgctggccgcctggaggtctggcatggcgggcgctggggcaccgtgtgtgatgacggctgggacctgcgcgatgccgccgtggcctgccggcagctgggctgcggaggggcactggccgccccgggaggcgccttcttcggggagggggcagggcctgtgtggctcagcgagctggcttgccggggcaacgaggggcagctgggcctctgccaccaccggggctggaaggcccacatctgctcccacgaggaggacgcgggcgtcgtctgcgcaggtcagcgtgtggctaactccagggacgactcaacatctcccctggatggggctccctggccagggctgttgctggagctgagccccagcacggaggagcccctggtgacacatgccccccgcccagctgggaacccccagaacgcctcccggaagaagagcccccggcccaagcaggccaagtccacccgggcccctctgctgacgacaggagccccccgccaagagcggctgcgcctggtctctggcccccacaggtgcgccggacgcctggaggtctggcacggcgggcgctggggcaccgtatgtgacgatggctgggacctgcgcgacgctgctgtagcctgccgggaactgggctgtgggggggcgctggctgcccccggcggtgccagattcgggcctggtgcagggcccgtgtggatggacgatgtggggtgtggaggaggagaacaggccctccgagactgcccccgaagcccctggggccggagcaactgtgaccacagcgaggatgcggggctggtctgcaccggcccagcacctcggctgcgcctggccgatggcccccacgggtgcgccggccgcctggaggtctggcacgggggtcgctgggggtcggtgtgtgacgacgcctgggacctgcgagacgccgctgtggcctgccgagagctgggctgcggaggggcgctggccgcccccgggggcgccttctttggggaggggtctggacccatcatcctggacgaccttcggtgtcggggaaacgagacggccttacgattctgcccagctcggccctggggccagcatgactgtcaccaccgcgaggacgccggggccgtgtgtgacggcatgcccctgggctacgtccctcccacggcccccacggacagcaacaactccacgcccagggaggctgcctccaggcccccgtccaccatgacgagccaggctccagggacggcaggcgtttcacctcctccagcctcccctactgtcctttgggagcctggaccggaagccgggtccccccagctgcgcctggtggctgggcccagcaagtgctcaggtcgactggaggtgtggcatgaccagcgctgggggaccgtgtgtgacgatagctgggacatgcgggattcagctgtggtctgccgggagctgggctgtggtggacctcagcagccagaccctgctgctggccgctttggctggggtgcgggccccatctggctagatgatgtgggctgtgtggggaccgaggcttcactgtccgactgccctgctgctccctggggaaagcacaactgcgctcacaatgaggatgttggggtcacctgcactgggcccccaggcctggactccatctcagaccccttcagctggagctggattcctggactggggagagatcgggatgcctggctcccgggagagctggccaccaagccctctgcaagtgtgactgccagtgttctggagaaaacaaccacgaaggccccagggaaaatgcctaagagtactaagaagtgggtgacaaaaaatgcaaagagaccaaccactcaacccccagtgatgccaaccacgaaacactccagggcccaaagccccccagacctaacctcacagaccactgcagcactgaccactgaggcctcccgaagacctacctctgagtttaccagaaggccgaccacggaggccccccagagatggacctctcacaccactgccacgctgacccctcaggccccccgagaacggaccactaagaccatggcaatgctgaccactcaaggcccccaagaaatgacctctgagtccactatcaagagtatccctcaggcctccctggagccatctgctgagatcccagaagggtctccagagtcacccaaagacccggccccctctcccagtgttagcaccactggggaatcaggcctgttccgggttcgtctggccgatgggcccaaccgctgtgctggccggctggaagtgtggcatgccggacgctggggaacagtgtgtgatgacaactgggacctgcgggacgccactgtggcctgctgggaactgggctgtggaaaggtccggcctcgagtaggcaaaacccattacggccctgggactgggcccatctggctggatgacatgggctgtaagggaagcgaggcctcactgagcgactgcccctcgggggcttgggggaagcacaactgtgaccacgaggaagacgtggggctcacctgcactggctacacagactatgacgattatcccccctggacctgggaccccacctcaagagaggacctggccaaggggactaccacagcgggggtacctggacacactctcccctggaggaccacccggcgcccgggtagctcctccccagcaataaggcgcctgccggacacagagccggaagcgggagctccgagaggtgatgctcctcgttcaaggactgccagggttgcagcgcctccctagcccatagcgccccctcgtggtggaggcgggcacgtgccgggcacagcggctgcggagacagcgggtccggcctcgggacccctcccgtagggtagggaggcagccaatgagcagaaataaatgcagaatcacaaactg

SEQ ID NO: 1824 - DNA, 9362 bp, Homo sapiens
aaaagtcagagccccacctccaccttagtctcgatccgaaaacgcggccccggcagcccctactaggcgcccccagcccgccctcacatccctccagtccatcggagtttttcactcggagccccggaccctcccccgagccgcagcctctctccccgccccggatcggagccccccgtccccgccccgggagctaagaggtgcaaacgcgccctcctccaactcctcccgcccccaactcccccccgagtggcagctctgggctgggaacgcggcggggtcggcctctcggctttgcgttcccgccccgggtccccggcgccgcaggagcccgccctgcagcgctgagtcccgcgcgtccgcctgccgtgcccgcctccacgcgcgccgcctcgcagcctccaggggacacgccatgactctggagggtctgtatttggcaaggggccccctggcccggctcctgctggcctggtcggccctgttgtgcatggcaggtggccaaggccgctgggacggggccttggaggctgcaggtcctggacgtgtgcggaggcggggcagcccaggcatcttgcaggggccgaatgtgtgcggctcccggttccatgcctactgctgtccaggctggaggacattccctggcaggagccagtgtgtcgtacccatctgtaggcgcgcctgcggtgaaggcttctgctcccagcccaacctgtgcacctgtgcggatgggacgctggctcccagctgcggggtgagccgagggtcagggtgcagtgtgagctgtatgaatgggggcacctgccggggggcgtcctgtctgtgtcagaagggctacacaggcaccgtgtgtgggcagcccatctgtgaccgcggctgccacaatgggggtcgctgcattgggcccaaccgctgcgcctgtgtgtatggcttcatgggacctcaatgtgagagagattaccggacgggaccctgctttggccaagtaggccccgaggggtgccagcatcagctgacgggcctcgtgtgcaccaaggcactttgctgtgccactgtgggccgtgcctggggccttccatgtgaactttgccctgcacagccacacccctgccgccgcggcttcatccccaatatccacacgggggcctgccaagatgtggatgagtgccaggctgtgccaggcctgtgccagggaggcagctgcgtcaacatggtgggctccttccattgccgctgtccagttggacaccggctcagtgacagcagcgccgcatgtgaagactaccgggccggcgcctgcttctcagtgcttttcgggggccgctgtgctggagacctcgccggccactacactcgcaggcagtgctgctgtgacaggggcaggtgctgggcagctggcccggtccctgagctgtgtcctcctcggggctccaatgaattccagcaactgtgcgcccagcggctgccgctgctacccggccaccctggcctcttccctggcctcctgggcttcggatccaatggcatgggtccccctcttgggccagcgcgactcaacccccatggctctgatgcgcgtgggatccccagcctgggccctggcaactctaatattggcactgctaccctgaaccagaccattgacatctgccgacacttcaccaacctgtgtctgaatggccgctgcctgcccacgccttccagctaccgctgcgagtgtaacgtgggctacacccaggacgtgcgcggcgagtgcattgatgtagacgaatgcaccagcagcccctgccaccacggtgactgcgtcaacatccccggcacctaccactgccggtgctacccgggcttccaggccacgcccaccaggcaggcatgcgtggatgtggacgagtgcattgtcagtggtggcctttgtcacctgggccgctgtgtcaacacagagggcagcttccagtgtgtctgcaatgcaggcttcgagctcagccctgacggcaagaactgtgtggaccacaacgagtgtgccaccagcaccatgtgcgtcaacggcgtgtgtctcaacgaggatggcagcttctcctgcctctgcaaacccggcttcctgctggcgcctggcggccactactgcatggacattgacgagtgccagacgcccggcatctgcgtgaacggccactgtaccaacaccgagggctccttccgctgccagtgcctgggggggctggcggtaggcacggatggccgcgtgtgcgtggacacccacgtgcgcagcacctgctatggggccatcgagaagggctcctgtgcccgccccttccctggcactgtcaccaagtccgagtgctgctgtgccaatccggaccacggttttggggagccctgccagctttgtcctgccaaagactccgctgagttccaggcactgtgcagcagtgggcttggcattaccacggatggtcgagacatcaacgagtgtgctctggatcctgaggtttgtgccaatggcgtgtgcgagaaccttcggggcagctaccgctgtgtctgcaacctgggttatgaggcaggtgcctcaggcaaggactgcacagacgtggatgagtgtgccctcaacagcctcctgtgtgacaacgggtggtgccagaatagccctggcagctacagctgctcctgcccccccggcttccacttctggcaggacacggagatctgcaaagatgtcgacgaatgcctgtccagcccgtgtgtgagtggcgtctgtcggaacctggccggctcctacacctgcaaatgtggccctggcagccggctggacccctctggtaccttctgtctagacagcaccaagggcacctgctggctgaagatccaggagagccgctgtgaggtgaaccttcagggagccagcctgcggtctgagtgctgcgccaccctcggggcagcctgggggagcccctgcgaacgctgcgagatcgaccctgcctgtgcccggggctttgcccggatgacgggtgtcacctgcgatgatgtgaacgagtgtgagtccttcccgggagtctgtcccaacgggcgttgcgtcaacactgctgggtctttccgctgtgagtgtccagagggcctgatgctggacgcctcaggccggctgtgcgtggatgtgagattggaaccatgtttcctgcgatgggatgaggatgagtgtggggtcaccctgcctggcaagtaccggatggacgtctgctgctgctccatcggggccgtgtggggagtcgagtgcgaggcctgcccggatcccgagtctctggagttcgccagcctgtgcccgcgggggctgggcttcgccagccgggacttcctgtctggccgaccattctataaagatgtgaatgaatgcaaggtgttccctggcctctgcacgcacggtacctgcagaaacacggtgggcagcttccactgcgcctgtgcggggggcttcgccctggatgcccaggaacggaactgcacagatatcgacgagtgtcgcatctctcctgacctctgcggccagggcacctgtgtcaacacgccgggcagctttgagtgcgagtgttttcccggctacgagagtggcttcatgctgatgaagaactgcatggacgtggacgagtgtgcaagggacccgctgctctgccggggaggcacttgcaccaacacggatgggagctacaagtgccagtgtccccctgggcatgagctgacggccaagggcactgcctgtgaggacatcgatgagtgctccctgagtgatggcctgtgtccccatggccagtgtgtcaatgtcatcggtgccttccagtgctcctgccatgccggcttccagagcacacctgaccgccagggctgcgtggacatcaacgaatgccgggtccagaatggtgggtgtgacgtgcactgtattaacactgagggcagctaccggtgcagctgtgggcagggctactcgctgatgcccgacggaagggcatgtgcagacgtggacgagtgtgaagagaacccccgcgtttgtgaccaaggccactgcaccaacatgccagggggtcaccgctgcctgtgctatgatggcttcatggccacgccagacatgaggacatgtgttgatgtggatgagtgtgacctgaaccctcacatctgcctccatggggactgcgagaacacgaagggttcctttgtctgccactgtcagctgggctacatggtcaggaagggggccacaggctgctctgatgtggatgaatgcgaggttggaggacacaactgtgacagtcacgcctcctgtctcaacatcccggggagtttcagctgtaggtgcctgccaggctgggtgggggatggcttcgaatgtcacgacctggatgaatgcgtctcccaggagcaccggtgcagcccaagaggtgactgtctcaatgtccctggctcctaccgctgcacctgccgccagggctttgccggggatggcttcttctgcgaagacagggatgaatgtgccgagaacgtggacctctgtgacaacgggcagtgcctcaatgcgcccggcgggtaccgctgtgaatgtgagatgggctttgaccccaccgaggaccaccgggcctgccaggatgtggacgagtgtgcgcaagggaacctctgtgcatttgggagctgtgagaacctgcctggaatgttccgctgcatctgcaatggtggctacgaactggaccgagggggtggcaactgcacagacatcaacgagtgtgcagacccagtaaactgcatcaacggcgtgtgcattaacacccccggcagctacctctgcagctgcccccaggattttgagctgaaccccagcggagtgggctgcgtggacactcgggccgggaactgtttcctggagacgcatgaccgaggggacagtggcatttcctgcagtgccgagatcggagttggtgtcacccgagcttcctgctgttgctccctgggccgggcttggggcaatccctgtgagctgtgccctatggccaacaccactgagtacagaaccctgtgcccgggtggtgagggcttccagcctaaccgcatcactgtcattctggaagacatcgacgagtgccaagagctgccagggctgtgtcaggggggtgactgcgtcaacacgtttggcagtttccagtgtgagtgcccacctggctaccacctcagtgagcacacccgcatctgtgaggatattgacgaatgctccacacactccggcatctgtggccctggcacctgctacaacaccctggggaactacacctgtgtctgccctgcagagtacctccaagtcaatggtggcaacaactgcatggatatgaggaagagtgtctgcttccggcactataacggcacatgtcaaaatgagctggccttcaacgtgacccggaaaatgtgttgctgctcctacaacattggccaggcctggaatagaccctgtgaggcctgccccactcccatcagtcctgactaccagatcctgtgtggaaatcaggccccgggattcctcactgacatccacacggggaagccccttgacattgatgagtgtggggagatccccgccatctgtgccaatggcatctgcataaaccagatcgggagtttccgctgcgagtgccccgcaggcttcaactacaacagcatcctgctggcttgtgaagatgtcgatgagtgtggcagcagggagagtccctgccagcagaatgctgactgcatcaacatccccggtagctaccgctgcaagtgcacccgagggtacaaactgtcgccaggcggggcttgtgtgggacggaatgagtgtcgggagatcccgaatgtctgtagccatggtgactgcatggacacagaaggcagctacatgtgtctgtgtcaccgtggattccaggcctctgcagaccagaccctgtgcatggacattgacgagtgtgaccggcagccttgtggaaatgggacctgcaagaacatcattggctcctacaactgcctctgcttccctggctttgtggtgacacacaatggggattgtgtggattttgatgagtgtactaccctggtggggcaggtgtgccgatttggccattgcctcaacacagctggttccttccactgcctctgccaggatggctttgagctcacagctgatgggaagaactgtgtggacaccaatgagtgcctcagccttgcaggaacctgcctacccggcacttgccagaacctcgagggctccttccgctgcatctgtccccctggcttccaggtgcagagtgaccactgcattgatatcgacgagtgctcagaggagcccaacctctgcctctttggcacctgtaccaacagccctgggagcttccagtgcctctgcccacctggctttgtcctctctgacaatgggcaccgttgctttgacacacggcagagtttctgcttcacccgttttgaggctgggaagtgctcggtgcccaaagctttcaacaccaccaagacccgctgctgctgcagtaagaggcctggggagggctggggagacccctgcgaactgtgtccccaggagggcagcgctgcctttcaggagctctgcccctttggccacggggcagtcccaggcccggatgactcccgagaagacgtgaatgagtgtgcagagaaccctggcgtctgcactaacggcgtctgtgtcaacaccgatggatccttccgctgtgagtgtccctttggctacagcctggacttcactggcatcaactgtgtggacacagacgagtgctctgtcggccacccctgtgggcaagggacatgcaccaatgtcatcggaggcttcgaatgtgcctgtgctgacggctttgagcctggcctcatgatgacctgcgaggacatcgacgaatgctccctgaacccgctgctctgtgccttccgctgccacaataccgagggctcctacctgtgcacctgtccagccggctacaccctgcgggaggatggggccatgtgtcgagatgtggacgagtgtgcagatggtcagcaggactgccacgcccggggcatggagtgcaagaacctcatcggtaccttcgcgtgcgtctgtcccccaggcatgcggcccctgcctggctctggggagggctgcacagatgacaatgaatgccacgctcagcctgacctctgtgtcaacggccgctgtgtcaacaccgcgggcagcttccggtgcgactgtgatgagggattccagcccagccccacccttaccgagtgccacgacatccggcaggggccctgctttgccgaggtgctgcagaccatgtgccggtctctgtccagcagcagtgaggctgtcaccagggccgagtgctgctgtgggggtggccggggctgggggccccgctgcgagctctgtcccctgcccggcacctctgcctacaggaagctgtgcccccatggctcaggctacactgctgagggccgagatgtagatgaatgccgtatgcttgctcacctgtgtgctcatggggagtgcatcaacagccttggctccttccgctgccactgtcaggccgggtacacaccggatgctactgctactacctgcctggatatggatgagtgcagccaggtccccaagccatgtaccttcctctgcaaaaacacgaagggcagtttcctgtgcagctgtccccgaggctacctgctggaggaggatggcaggacctgcaaagacctggacgaatgcacctcccggcagcacaactgtcagttcctctgtgtcaacactgtgggcgccttcacctgccgctgtccgcccggcttcacccagcaccaccaggcctgcttcgacaatgatgagtgctcagcccagcctggcccatgtggtgcccacgggcactgccacaacaccccgggcagcttccgctgtgaatgccaccaaggcttcaccctggtcagctcaggccatggctgtgaagatgtgaatgaatgtgatgggccccaccgctgccagcatggctgtcagaaccagctagggggctaccgctgcagctgcccccagggtttcacccagcactcccagtgggcccagtgtgtggatgagaatgagtgtgccctgtcgccccccacctgcgggagcgcctcctgtcgcaacactcttggtggcttccgctgcgtctgcccctctggctttgactttgatcaggccctcgggggctgccaggaggtggatgagtgcgccggacggcgtggcccctgtagctacagctgtgccaacacgcctggtggcttcctgtgcggctgtcctcaaggctacttccgggctgggcaagggcactgtgtctccggcctgggcttcagccccggaccccaggacaccccggacaaagaggagctgctctcgtctgaagcctgctacgaatgcaagatcaatggcctctcccctcgggaccggccacgacgcagtgcccacagggaccaccaggtgaacctggccacccttgactccgaggccctgctgaccttgggcctgaacctctcacacctgggccgggccgagcgcatcctggagctccggccggccctggagggtctagagggccggatccgctacgtcatcgtccgcggaaacgagcaaggtttctttcgcatgcatcacctccgtggcgtcagctccctgcagctggggcggaggcggccggggcctggaacctaccggctggaggtggtgagccacatggcaggaccctggggtgtccagccagaggggcagccagggccatggggccaggccttgaggctgaaggtgcagctgcagttgctttagttgggaggagcctcagtgggccccagctgtccagagaagggggattctggaactgggaaggactgatccccagaagcgatggctgaccagattgaaccccgaaactcaggaagagtgaaatgctacacgacaacctcaggcaagcccggcctctgcctgggcctctgtgccagccccgggggccccccagttactcagtctttcctggagacagcaagaagctgcaatgtgcaatccccctgcccccacagccaaggtcaggaagaggccctgtggtcaccgtgtctggccaatctcaggctttcacttctgtactgcactgtggcttgccctggcggggggcagggggttggcaggacatggcaatgggcaactggggtgggcacagggcttattcctcggagtagaagggtgtacagggggcccagactccacagtgacttgccacatttgccccccatttggagaatgcttttatatcaaaagtggagacgataataaagttattttgggttaa

SEQ ID NO: 1825 - DNA, 2505 bp, Homo sapiens
agccagaccaggaacccaccagaaggaaccaattccggacacataacaagcagcagtgaggacaccaaagacacagacccagatgcagaggcagaggcagccacacagcccctcccagccacaatcacaacctcatattcatataatcacagaccctccaccccacatagtgggtggaatcctgccagcgcattccactcacacacacacaaaatcccattctcacacacgtgcacccaagcctcgtcccgcacacacaacatgacaggccacagagccggctgagagtctcagcacgcatggacgcctgcactgcgcaggttgcagcccaggctgcaggaccacaggtggcagggacgacacagcaggtggccggccagggagtggcagtggcctccatcctccctgctcagccacagcccctgcttcagcgtctgccagtccaactgtcaactcatccactcaactttacaactggaatgtgggggcgttcagggccctgccactggtgacggccactctaagtcctacccaatgctgggtaggtcctttaagaggcccaagtcctgggcgctactatgaggttctgtacgtgcacagtgatggctcatgcctggccgaggtgagcccactcagtctgggtggcacagcctaatctaggaactgctctgcggttctacatggctctcagcagcccagtgagtgtcctctgcaccgggcgtgtccctcaggtgctcctagccagaccctcccttgacacagtagggcacaaaccgctattggagcggcactggcacccgagtgtacaagcgtcagcatccctgctgccttccccacccccagctgtccccacctgctgattctgcccctggggtcacacttacaatttagggtcctgtcaggagacaaaaatcacgtgagtgacatcagctccctcatatgtaggtgctgggaaaagggcttgtggggtgcctgtataaactggccataaaaatacgggaataagttgtggaaagccacaaaaggcctctgaggaggaaagcctcctaattgccatcatgttcccatgctcagagcaagacccgctgtcttctctgtaaacactgtgctcagggagaaagacacttctttgaaacactggaatgtggacagacgtgcaggctcccagtcaaggccgctcctactagctactctccaacaagttaaagttatgctgtttgagcacaaaggagactcatttaaactgctattgctatagattatgcctgtgatgcactgccaccctttcactgtttctccctgaacatctgcttcttagatcgaagggactgtactcaataaatagtgtggagaccagagctcggcaccttttgcagcctccacattttgcactggccccctggctccccacctttcactcttaacttgtcttttctcaatcctttgtcaccaccagacttcgggtaccctacgggtagtgttgaggctggtccccaacatgtaggatcccttcactgtgtcacatgtgtccctaacacacttgctacatctcatgtcctttaggttctgtgttttactccagataatgttctttgaatctaaattacagtttactgatttctcaaaagctgcacctaatgtgctatccattcagacagacatactcacttagcaaatgtttgttgagccagcactcagtggcagattctgtgctagggcgtgccaagtgcagacacacgtttgccaagacacagggtcacatgtgcatgcacactcagacttgcaggcttacaccagtgttcagcctgctcccaatcccagggagctccagggaggacagagagaatgtcacaacacccaacccctcccactgcatgctgagtccagttcccgatacgctgccaccccaacagcatggcccagggccgagggtctctctgcagacctgccctgaccacattcacacacacacacacacacacacacacacacacacacacacacacacacacgaagaggcatgtgccttgttcagatatacataaagctcacccatcgccaaattccctgcctgtgcctgctgggaccagactccgctgtcatgagggtgacatccgccacctgtgctcttctgctggctctgatctgcagcgtccagctgggggatgcctgcctggatatcgataaactgcttgcgaatgttgtgtttgatgtgtcccaagacctcctgaaggaggagcttgctcgttacaaccccagtcccctgacagaggagtccttcctcaatgtccagcaatgctttgccaatgtctccgtgacagaaagatttgctcattcagttgttattaagaagatccttcagagcaacgattgcatagaagcagccttctgatctgaggacccctgcagatcagatattggccctcctgccttccttggggctccccgcgttcctggcctggctctgttcatcactacagagaccccaatgaacacctgcagctc

SEQ ID NO: 1826 - DNA, 2480 bp, Homo sapiens
agactcgctcctcccggcagggcgcacctaggcgggtccatcgccagccggggagaggggtttgggcagggagggaacaggtgcgcggcgggacccgccctatctcaacaggtgaatcgctccaagtgggtctcggttgcatggatctcggtgcgcttggtttggccggagcagatgggggccggaagggacctgtggtccgcaggcgccctcccagcgggccagtcacttggttcgggccctgggggacggagcgcacctgggtcagcccacttccggggagggaggcagaggaacccctccccgccgctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcac

SEQ ID NO: 1827 - protein, 196 aa, Homo sapiens
MSRRSMLLAWALPSLLRLGAAQETEDPACCSPIVPRNEWKALASECAQHLSLPLRYVVVSHTAGSSCNTPASCQQQARNVQHYHMKTLGWCDVGYNFLIGEDGLVYEGRGWNFTGAHSGHLWNPMSIGISFMGNYMDRVPTPQAIRAAQGLLACGVAQGALRSNYVLKGHRDVQRTLSPGNQLYHLIQNWPHYRSP

SEQ ID NO: 1828 - protein, 351 aa, Homo sapiens
MEAFALGPARRGRRRTRAAGSLLSRAAILLFISAFLVRVPSSVGHLVRLPRAFRLTKDSVKIVGSTSFPVKAYVMLHQKSPHVLCVTQQLRNAELIDPSFQWYGPKGKVVSVENRTAQITSTGSLVFQNFEESMSGIYTCFLEYKPTVEEIVKRLQLKYAIYAYREPHYYYQFTARYHAAPCNSIYNISFEKKLLQILSKLLLDLSCEISLLKSECHRVKMQRAGLQNELFFAFSVSSLDTEKGPKRCTDHNCEPYKRLFKAKNLIERFFNQQVEILGRRAEQLPQIYYIEGTLQMVWINRCFPGYGMNVQQHPKCPECCVICSPGSYNPRDGIHCLQCNSSLVYGAKTCL

SEQ ID NO: 1829 - protein, 139 aa, Homo sapiens
METNVFHLMLCVTSARTHKSTSLCFGHFNSYPSLPLIHDLLLEISFQLSAPHEDARLTPEELERASLLQILPEMLGAERGDILRKADSSTNIFNPRGNLRKFQDFSGQDPNILLSHLLARIWKPYKKRETPDCFWKYCV

SEQ ID NO: 1830 - protein, 201 aa, Homo sapiens
MGSGRRALSAVPAVLLVLTLPGLPVWAQNDTEPIVLEGKCLVVCDSNPATDSKGSSSSPLGISVRAANSKVAFSAVRSTNHEPSEMSNKTRIIYFDQILVNVGNFFTLESVFVAPRKGIYSFSFHVIKVYQSQTIQVNLMLNGKPVISAFAGDKDVTREAATNGVLLYLDKEDKVYLKLEKGNLVGGWQYSTFSGFLVFPL

SEQ ID NO: 1831 - protein, 87 aa, Homo sapiens
MKVLRAWLLCLLMLGLALRGAASRTHRHSMEIRTPDINPAWYASRGIRPVGRFGRRRATLGDVPKPGLRPRLTCFPLEGGAMSSQDG

SEQ ID NO: 1832 - protein, 365 aa, Homo sapiens
MPGGKKVAGGGSSGATPTSAAATAPSGVRRLETSEGTSAQRDEEPEEEGEEDLRDGGVPFFVNRGGLPVDEATWERMWKHVAKIHPDGEKVAQRIRGATDLPKIPIPSVPTFQPSTPVPERLEAVQRYIRELQYNHTGTQFFEIKKSRPLTGLMDLAKEMTKEALPIKCLEAVILGIYLTNSMPTLERFPISFKTYFSGNYFRHIVLGVNFAGRYGALGMSRREDLMYKPPAFRTLSELVLDFEAAYGRCWHVLKKVKLGQSVSHDPHSVEQIEWKHSVLDVERLGRDDFRKELERHARDMRLKIGKGTGPPSPTKDRKKDVSSPQRAQSSPHRRNSRSERRPSGDKKTSEPKAMPDLNGYQIRV

SEQ ID NO: 1833 - protein, 458 aa, Homo sapiens
MAWASRLGLLLALLLPVVGASTPGTVVRLNKAALSYVSEIGKAPLQRALQVTVPHFLDWSGEALQPTRIRILNVHVPRLHLKFIAGFGVRLLAAANFTFKVFRAPEPLELTLPVELLADTRVTQSSIRTPVVSISACSLFSGHANEFDGSNSTSHALLVLVQKHIKAVLSNKLCLSISNLVQGVNVHLGTLIGLNPVGPESQIRYSMVSVPTVTSDYISLEVNAVLFLLGKPIILPTDATPFVLPRHVGTEGSMATVGLSQQLFDSALLLLQKAGALNLDITGQLRSDDNLLNTSALGRLIPEVARQFPEPMPVVLKVRLGATPVAMLHTNNATLRLQPFVEVLATASNSAFQSLFSLDVVVNLRLQLSVSKVKLQGTTSVLGDVQLTVASSNVGFIDTDQVRTLMGTVFEKPLLDHLNALLAMGIALPGVVNLHYVAPEIFVYEGYVVISSGLFYQS

SEQ ID NO: 1834 - protein, 604 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRDDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 1835 - protein, 224 aa, Homo sapiens
MPGRAPLRTVPGALGAWLLGGLWAWTLCGLCSLGAVGAPRPCQAPQQWEGRQVMYQQSSGRNSRALLSYDGLNQRVRVLDERKALIPCKRLFEYILLYKDGVMFQIDQATKQCSKMTLTQPWDPLDIPQNSTFEDQYSIGGPQEQITVQEWSDRKSARSYETWIGIYTVKDCYPVQETFTINYSVILSTRFFDIQLGIKDPSVFTPPSTCQMAQLEKMSEDCSW

SEQ ID NO: 1836 - protein, 1701 aa, Homo sapiens
MGFLPKLLLLASFFPAGQASWGVSSPQDVQGVKGSCLLIPCIFSFPADVEVPDGITAIWYYDYSGQRQVVSHSADPKLVEARFRGRTEFMGNPEHRVCNLLLKDLQPEDSGSYNFRFEISEVNRWSDVKGTLVTVTEEPRVPTIASPVELLEGTEVDFNCSTPYVCLQEQVRLQWQGQDPARSVTFNSQKFEPTGVGHLETLHMAMSWQDHGRILRCQLSVANHRAQSEIHLQVKYAPKGVKILLSPSGRNILPGELVTLTCQVNSSYPAVSSIKWLKDGVRLQTKTGVLHLPQAAWSDAGVYTCQAENGVGSLVSPPISLHIFMAEVQVSPAGPILENQTVTLVCNTPNEAPSDLRYSWYKNHVLLEDAHSHTLRLHLATRADTGFYFCEVQNVHGSERSGPVSVVVNHPPLTPVLTAFLETQAGLVGILHCSVVSEPLATLVLSHGGHILASTSGDSDHSPRFSGTSGPNSLRLEIRDLEETDSGEYKCSATNSLGNATSTLDFHANAARLLISPAAEVVEGQAVTLSCRSGLSPTPDARFSWYLNGALLHEGPGSSLLLPAASSTDAGSYHCRARDGHSASGPSSPAVLTVLYPPRQPTFTTRLDLDAAGAGAGRRGLLLCRVDSDPPARLQLLHKDRVVATSLPSGGGCSTCGGCSPRMKVTKAPNLLRVEIHNPLLEEEGLYLCEASNALGNASTSATFNGQATVLAIAPSHTLQEGTEANLTCNVSREAAGSPANFSWFRNGVLWAQGPLETVTLLPVARTDAALYACRILTEAGAQLSTPVLLSVLYPPDRPKLSALLDMGQGHMALFICTVDSRPLALLALFHGEHLLATSLGPQVPSHGRFQAKAEANSLKLEVRELGLGDSGSYRCEATNVLGSSNTSLFFQVRGAWVQVSPSPELQEGQAVVLSCQVHTGVPEGTSYRWYRDGQPLQESTSATLRFAAITLTQAGAYHCQAQAPGSATTSLAAPISLHVSYAPRHVTLTTLMDTGPGRLGLLLCRVDSDPPAQLRLLHGDRLVASTLQGVGGPEGSSPRLHVAVAPNTLRLEIHGAMLEDEGVYICEASNTLGQASASADFDAQAVNVQVWPGATVREGQLVNLTCLVWTTHPAQLTYTWYQDGQQRLDAHSIPLPNVTVRDATSYRCGVGPPGRAPRLSRPITLDVLYAPRNLRLTYLLESHGGQLALVLCTVDSRPPAQLALSHAGRLLASSTAASVPNTLRLELRGPQPRDEGFYSCSARSPLGQANTSLELRLEGVRVILAPEAAVPEGAPITVTCADPAAHAPTLYTWYHNGRWLQEGPAASLSFLVATRAHAGAYSCQAQDAQGTRSSRPAALQVLYAPQDAVLSSFRDSRARSMAVIQCTVDSEPPAELALSHDGKVLATSSGVHSLASGTGHVQVARNALRLQVQDVPAGDDTYVCTAQNLLGSISTIGRLQVEGARVVAEPGLDVPEGAALNLSCRLLGGPGPVGNSTFAWFWNDRRLHAEPVPTLAFTHVARAQAGMYHCLAELPTGAAASAPVMLRVLYPPKTPTMMVFVEPEGGLRGILDCRVDSEPLASLTLHLGSRLVASSQPQGAPAEPHIHVLASPNALRVDIEALRPSDQGEYICSASNVLGSASTSTYFGVRALHRLHQFQQLLWVLGLLVGLLLLLLGLGACYTWSSLILMQPHVRPQPVPHPWADQWCCLPSGGESGQNL

SEQ ID NO: 1837 - protein, 305 aa, Homo sapiens
MAAGLARLLLLLGLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALTFETPLVCHPHALLVYPTLPEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 1838 - protein, 1761 aa, Homo sapiens
MQFQLTLFLHLGWLSYSKAQDDCNRGACHPTTGDLLVGRNTQLMASSTCGLSRAQKYCILSYLEGEQKCFICDSRFPYDPYDQPNSHTIENVIVSFEPDREKKWWQSENGLDHVSIRLDLEALFRFSHLILTFKTFRPAAMLVERSTDYGHNWKVFKYFAKDCATSFPNITSGQAQGVGDIVCDSKYSDIEPSTGGEVVLKVLDPSFEIENPYSPYIQDLVTLTNLRINFTKLHTLGDALLGRRQNDSLDKYYYALYEMIVRGSCFCNGHASECRPMQKMRGDVFSPPGMVHGQCVCQHNTDGPNCERCKDFFQDAPWRPAADLQDNACRSCSCNSHSSRCHFDMTTYLASGGLSGGVCEDCQHNTEGQHCDRCRPLFYRDPLKTISDPYACIPCECDPDGTISGGICVSHSDPALGSVAGQCLCKENVEGAKCDQCKPNHYGLSATDPLGCQPCDCNPLGSLPFLTCDVDTGQCLCLSYVTGAHCEECTVGYWGLGNHLHGCSPCDCDIGGAYSNVCSPKNGQCECRPHVTGRSCSEPAPGYFFAPLNFYLYEAEEATTLQGLAPLGSETFGQSPAVHVVLGEPVPGNPVTWTGPGFARVLPGAGLRFAVNNIPFPVDFTIAIHYETQSAADWTVQIVVNPPGGSEHCIPKTLQSKPQSFALPAATRIMLLPTPICLEPDVQYSIDVYFSQPLQGESHAHSHVLVDSLGLIPQINSLENFCSKQDLDEYQLHNCVEIASAMGPQVLPGACERLIISMSAKLHDGAVACKCHPQGSVGSSCSRLGGQCQCKPLVVGRCCDRCSTGSYDLGHHGCHPCHCHPQGSKDTVCDQVTGQCPCHGEVSGRRCDRCLAGYFGFPSCHPCPCNRFAELCDPETGSCFNCGGFTTGRNCERCIDGYYGNPSSGQPCRPCLCPDDPSSNQYFAHSCYQNLWSSDVICNCLQGYTGTQCGECSTGFYGNPRISGAPCQPCACNNNIDVTDPESCSRVTGECLRCLHNTQGANCQLCKPGHYGSALNQTCRRCSCHASGVSPMECPPGGGACLCDPVTGACPCLPNVTGLACDRCADGYWNLVPGRGCQSCDCDPRTSQSSHCDQLTGQCPCKLGYGGKRCSECQENYYGDPPGRCIPCDCNRAGTQKPICDPDTGMCRCREGVSGQRCDRCARGHSQEFPTCLQCHLCFDQWDHTISSLSKAVQGLMRLAANMEDKRETLPVCEADFKDLRGNVSEIERILKHPVFPSGKFLKVKDYHDSVRRQIMQLNEQLKAVYEFQDLKDTIERAKNEADLLLEDLQEEIDLQSSVLNASIADSSENIKKYYHISSSAEKKINETSSTINTSANTRNDLLTILDTLTSKGNLSLERLKQIKIPDIQILNEKVCGDPGNVPCVPLPCGGALCTGRKGHRKCRGPGCHGSLTLSTNALQKAQEAKSIIRNLDKQVRGLKNQIESISEQAEVSKNNALQLREKLGNIRNQSDSEEENINLFIKKVKNFLLEENVPPEDIEKVANGVLDIHLPIPSQNLTDELVKIQKHMQLCEDYRTDENRLNEEADGAQKLLVKAKAAEKAANILLNLDKTLNQLQQAQITQGRANSTITQLTANITKIKKNVLQAENQTREMKSELELAKQRSGLEDGLSLLQTKLQRHQDHAVNAKVQAESAQHQAGSLEKEFVELKKQYAILQRKTSTTGLTKETLGKVKQLKDAAEKLAGDTEAKIRRITDLERKIQDLNLSRQAKADQLRILEDQVVAIKNEIVEQEKKYARCYS

SEQ ID NO: 1839 - protein, 950 aa, Homo sapiens
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 1840 - protein, 762 aa, Homo sapiens
MEGPRSSTHVPLVLPLLVLLLLAPARQAAAQRCPQACICDNSRRHVACRYQNLTEVPDAIPELTQRLDLQGNLLKVIPAAAFQGVPHLTHLDLRHCEVELVAEGAFRGLGRLLLLNLASNHLRELPQEALDGLGSLRRLELEGNALEELRPGTFGALGALATLNLAHNALVYLPAMAFQGLLRVRWLRLSHNALSVLAPEALAGLPALRRLSLHHNELQALPGPVLSQARGLARLELGHNPLTYAGEEDGLALPGLRELLLDGGALQALGPRAFAHCPRLHTLDLRGNQLDTLPPLQGPGQLRRLRLQGNPLWCGCQARPLLEWLARARVRSDGACQGPRRLRGEALDALRPWDLRCPGDAAQEEEELEERAVAGPRAPPRGPPRGPGEERAVAPCPRACVCVPESRHSSCEGCGLQAVPRGFPSDTQLLDLRRNHFPSVPRAAFPGLGHLVSLHLQHCGIAELEAGALAGLGRLIYLYLSDNQLAGLSAAALEGAPRLGYLYLERNRFLQVPGAALRALPSLFSLHLQDNAVDRLAPGDLGRTRALRWVYLSGNRITEVSLGALGPARELEKLHLDRNQLREVPTGALEGLPALLELQLSGNPLRALRDGAFQPVGRSLQHLFLNSSGLEQICPGAFSGLGPGLQSLHLQKNQLRALPALPSLSQLELIDLSSNPFHCDCQLLPLHRWLTGLNLRVGATCATPPNARGQRVKAAAAVFEDCPGWAARKAKRTPASRPSARRTPIKGRQCGADKVGKEKGRL

SEQ ID NO: 1841 - protein, 253 aa, Homo sapiens
MPLLPSTVGLAGLLFWAGQAVNALIMPNATPAPAQPESTAMRLLSGLEVPRYRRKRHISVRDMNALLDYHNHIRASVYPPAANMEYMVWDKRLARAAEAWATQCIWAHGPSQLMRYVGQNLSIHSGQYRSVVDLMKSWSEEKWHYLFPAPRDCNPHCPWRCDGPTCSHYTQMVWASSNRLGCAIHTCSSISVWGNTWHRAAYLVCNYAIKGNWIGESPYKMGKPCSSCPPSYQGSCNSNMCFKGLKSNKFTWF

SEQ ID NO: 1842 - protein, 2828 aa, Homo sapiens
MPKRAHWGALSVVLILLWGHPRVALACPHPCACYVPSEVHCTFRSLASVPAGIAKHVERINLGFNSIQALSETSFAGLTKLELLMIHGNEIPSIPDGALRDLSSLQVFKFSYNKLRVITGQTLQGLSNLMRLHIDHNKIEFIHPQAFNGLTSLRLLHLEGNLLHQLHPSTFSTFTFLDYFRLSTIRHLYLAENMVRTLPASMLRNMPLLENLYLQGNPWTCDCEMRWFLEWDAKSRGILKCKKDKAYEGGQLCAMCFSPKKLYKHEIHKLKDMTCLKPSIESPLRQNRSRSIEEEQEQEEDGGSQLILEKFQLPQWSISLNMTDEHGNMVNLVCDIKKPMDVYKIHLNQTDPPDIDINATVALDFECPMTRENYEKLWKLIAYYSEVPVKLHRELMLSKDPRVSYQYRQDADEEALYYTGVRAQILAEPEWVMQPSIDIQLNRRQSTAKKVLLSYYTQYSQTISTKDTRQARGRSWVMIEPSGAVQRDQTVLEGGPCQLSCNVKASESPSIFWVLPDGSILKAPMDDPDSKFSILSSGWLRIKSMEPSDSGLYQCIAQVRDEMDRMVYRVLVQSPSTQPAEKDTVTIGKNPGESVTLPCNALAIPEAHLSWILPNRRIINDLANTSHVYMLPNGTLSIPKVQVSDSGYYRCVAVNQQGADHFTVGITVTKKGSGLPSKRGRRPGAKALSRVREDIVEDEGGSGMGDEENTSRRLLHPKDQEVFLKTKDDAINGDKKAKKGRRKLKLWKHSEKEPETNVAEGRRVFESRRRINMANKQINPERWADILAKVRGKNLPKGTEVPPLIKTTSPPSLSLEVTPPFPAISPPSASPVQTVTSAEESSADVPLLGEEEHVLGTISSASMGLEHNHNGVILVEPEVTSTPLEEVVDDLSEKTEEITSTEGDLKGTAAPTLISEPYEPSPTLHTLDTVYEKPTHEETATEGWSAADVGSSPEPTSSEYEPPLDAVSLAESEPMQYFDPDLETKSQPDEDKMKEDTFAHLTPTPTIWVNDSSTSQLFEDSTIGEPGVPGQSHLQGLTDNIHLVKSSLSTQDTLLIKKGMKEMSQTLQGGNMLEGDPTHSRSSESEGQESKSITLPDSTLGIMSSMSPVKKPAETTVGTLLDKDTTTATTTPRQKVAPSSTMSTHPSRRRPNGRRRLRPNKFRHRHKQTPPTTFAPSETFSTQPTQAPDIKISSQVESSLVPTAWVDNTVNTPKQLEMEKNAEPTSKGTPRRKHGKRPNKHRYTPSTVSSRASGSKPSPSPENKHRNIVTPSSETILLPRTVSLKTEGPYDSLDYMTTTRKIYSSYPKVQETLPVTYKPTSDGKEIKDDVATNVDKHKSDILVTGESITNAIPTSRSLVSTMGEFKEESSPVGFPGTPTWNPSRTAQPGRLQTGIPVTTSGENLTDPPLLKELEDVDFTSEFLSSLTVSTPFHQEEAGSSTTLSSIKVEVASSQAETTTLDQDHLETTVAILLSETRPQNHTPTAARMKEPASSSPSTILMSLGQTTTTKPALPSPRISQASRDSKENVFLNYVGNPETEATPVNNEGTQHMSGPNELSTPSSDQDAFNLSTKLELEKQVFGSRSLPRGPDSQRQDGRVHASHQLTRVPAKPILPTATVRLPEMSTQSASRYFVTSQSPRHWTNKPEITTYPSGALPENKQFTTPRLSSTTIPLPLHMSKPSIPSKFTDRRTDQFNGYSKVFGNNNIPEARNPVGKPPSPRIPHYSNGRLPFFTNKTLSFPQLGVTRRPQIPTSPAPVMRERKVIPGSYNRIHSHSTFHLDFGPPAPPLLHTPQTTGSPSTNLQNIPMVSSTQSSISFITSSVQSSGSFHQSSSKFFAGGPPASKFWSLGEKPQILTKSPQTVSVTAETDTVFPCEATGKPKPFVTWTKVSTGALMTPNTRIQRFEVLKNGTLVIRKVQVQDRGQYMCTASNLHGLDRMVVLLSVTVQQPQILASHYQDVTVYLGDTIAMECLAKGTPAPQISWIFPDRRVWQTVSPVEGRITLHENRTLSIKEASFSDRGVYKCVASNAAGADSLAIRLHVAALPPVIHQEKLENISLPPGLSIHIHCTAKAAPLPSVRWVLGDGTQIRPSQFLHGNLFVFPNGTLYIRNLAPKDSGRYECVAANLVGSARRTVQLNVQRAAANARITGTSPRRTDVRYGGTLKLDCSASGDPWPRILWRLPSKRMIDALFSFDSRIKVFANGTLVVKSVTDKDAGDYLCVARNKVGDDYVVLKVDVVMKPAKIEHKEENDHKVFYGGDLKVDCVATGLPNPEISWSLPDGSLVNSFMQSDDSGGRTKRYVVFNNGTLYFNEVGMREEGDYTCFAENQVGKDEMRVRVKVVTAPATIRNKTYLAVQVPYGDVVTVACEAKGEPMPKVTWLSPTNKVIPTSSEKYQIYQDGTLLIQKAQRSDSGNYTCLVRNSAGEDRKTVWIHVNVQPPKINGNPNPITTVREIAAGGSRKLIDCKAEGIPTPRVLWAFPEGVVLPAPYYGNRITVHGNGSLDIRSLRKSDSVQLVCMARNEGGEARLILQLTVLEPMEKPIFHDPISEKITAMAGHTISLNCSAAGTPTPSLVWVLPNGTDLQSGQQLQRFYHKADGMLHISGLSSVDAGAYRCVARNAAGHTERLVSLKVGLKPEANKQYHNLVSIINGETLKLPCTPPGAGQGRFSWTLPNGMHLEGPQTLGRVSLLDNGTLTVREASVFDRGTYVCRMETEYGPSVTSIPVIVIAYPPRITSEPTPVIYTRPGNTVKLNCMAMGIPKADITWELPDKSHLKAGVQARLYGNRFLHPQGSLTIQHATQRDAGFYKCMAKNILGSDSKTTYIHVF

SEQ ID NO: 1843 - protein, 1313 aa, Homo sapiens
MSGWRYLICVSFLLTILLELTYQGPPVPASSSTKLLMTSYSMRSTVVSRYAHTLVTSVLFNPHAEAHEAIFDLDLPHLAFISNFTMTINNKVYIAEVKEKHQAKKIYEEAHQQGKTAAHVGIRDRESEKFRISTSLAAGTEVTFSLAYEELLQRHQGQYQLVVSLRPGQLVKRLSIEVTVSERTGISYVHIPPLRTGRLRTNAHASEVDSPPSTRIERGETCVRITYCPTLQDQSSISGSGIMADFLVQYDVVMEDIIGDVQIYDDYFIHYFAPRGLPPMEKNVVFVIDVSSSMFGTKMEQTKTAMNVILSDLQANDYFNIISFSDTVNVWKAGGSIQATIQNVHSAKDYLHCMEADGWTDVNSALLAAASVLNHSNQEPGRGPSVGRIPLIIFLTDGEPTAGVTTPSVILSNVRQALGHRVSLFSLAFGDDADFTLLRRLSLENRGIARRIYEDTDAALQLKGLYEEISMPLLADVRLNYLGGLVGASPWAVFPNYFGGSELVVAGQVQPGKQELGIHLAARGPKDQLLVAHHSEGATNNSQKAFGCPGEPAPNVAHFIRRLWAYVTIGELLDAHFQARDTTTRHLLAAKVLNLSLEYNFVTPLTSLVMVQPKQASEETRRQTSTSAGPDTIMPSSSSRHGLGVSTAQPALVPKVISPKSRPVKPKFYLSSTTTASTKKMLSSKELEPLGESPHTLSMPTYPKAKIPAQQDSGTLAQPTLRTKPTILVPSNSGTLLPLKPGSLSHQNPDILPTNSRTQVPPVKPGIPASPKADTVKCVTPLHSKPGAPSHPQLGALTSQAPKGLPQSRPGVSTLQVPKYPLHTRPRVPAPKTRNNMPHLGPGILLSKTPKILLSLKPSAPPHQISTSISLSKPETPNPHMPQTPLPPRPDRPRPPLPESLSTFPNTISSSTGPSSTTTTSVLGEPLPMPFTPTLPPGRFWHQYDLLPGPQRTRQVLGPSRPGVPTMSLLNSSRPTPEGSPPNLPILLPSSILPEAISLLLLPEELELLSESMVESKFVESLNPPAFYTFLTPDEDGSPNWDGNSEEILGGAGGSMESQGSSVGLAKGTLPSIFTFSSSVDGDPHFVIQIPHSEEKICFTLNGHPGDLLQLIEDPKAGLHVSGKLLGAPPRPGHKDQTRTYFQIITVTTDKPRAYTITISRSSISLRGEGTLRLSWDQPALLKRPQLELYVAAAARLTLRLGPYLEFLVLRHRYRHPSTLQLPHLGFYVANGSGLSPSARGLIGQFQHADIRLVTGPMGPCLRRHHGPDVPVILGKRLLKDSPRLLPRWASCWLVKRSHVELLLGHPYLSYVL

SEQ ID NO: 1844 - protein, 193 aa, Homo sapiens
MLGVLELLLLGAAWLAGPARGQNETEPIVLEGKCLVVCDSNPTSDPTGTALGISVRSGSAKVAFSAIRSTNHEPSEMSNRTMIIYFDQVLVNIGNNFDSERSTFIAPRKGIYSFNFHVVKVYNRQTIQVSLMLNGWPVISAFAGDQDVTREAASNGVLIQMEKGDRAYLKLERGNLMGGWKYSTFSGFLVFPL

SEQ ID NO: 1845 - protein, 395 aa, Homo sapiens
MVSAAGLSGDGKMRGVLLVLLGLLYSSTSCGVQKASVFYGPDPKEGLVSSMEFPWVVSLQDSQYTHLAFGCILSEFWVLSIASAIQNRKDIVVIVGISNMDPSKIAHTEYPVNTIIIHEDFDNNSMSNNIALLKTDTAMHFGNLVQSICFLGRMLHTPPVLQNCWVSGWNPTSATGNHMTMSVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 1846 - protein, 412 aa, Homo sapiens
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPNENGPYFLALREMIEEMYQLYGGPVVLVAHSMGNMYTLYFLQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 1847 - protein, 472 aa, Homo sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQYRTQGAVEAAKVGALASLIRSVASFSIYSPHTGIQEYQDGVPKIPTACITVEDAEMMSRMASHGIKIVIQLKMGAKTYPDTDSFNTVAEITGSKYPEQVVLVSGHLDSWDVGQGAMDDGGGAFISWEALSLIKDLGLRPKRTLRLVLWTAEEQGGVGAFQYYQLHKVNISNYSLVMESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 1848 - protein, 5405 aa, Homo sapiens
MGALWSWWILWAGATLLWGLTQEASVDLKNTGREEFLTAFLQNYQLAYSKAYPRLLISSLSESPASVSILSQADNTSKKVTVRPGESVMVNISAKAEMIGSKIFQHAVVIHSDYAISVQALNAKPDTAELTLLRPIQALGTEYFVLTPPGTSARNVKEFAVVAGAAGASVSVTLKGSVTFNGKFYPAGDVLRVTLQPYNVAQLQSSVDLSGSKVTASSPVAVLSGHSCAQKHTTCNHVVEQLLPTSAWGTHYVVPTLASQSRYDLAFVVASQATKLTYNHGGITGSRGLQAGDVVEFEVRPSWPLYLSANVGIQVLLFGTGAIRNEVTYDPYLVLIPDVAAYCPAYVVKSVPGCEGVALVVAQTKAISGLTIDGHAVGAKLTWEAVPGSEFSYAEVELGTADMIHTAEATTNLGLLTFGLAKAIGYATAADCGRTVLSPVEPSCEGMQCAAGQRCQVVGGKAGCVAESTAVCRAQGDPHYTTFDGRRYDMMGTCSYTMVELCSEDDTLPAFSVEAKNEHRGSRRVSYVGLVTVRAYSHSVSLTRGEVGFVLVDNQRSRLPVSLSEGRLRVYQSGPRAVVELVFGLVVTYDWDCQLALSLPARFQDQVCGLCGNYNGDPADDFLTPDGALAPDAVEFASSWKLDDGDYLCEDGCQNNCPACTPGQAQHYEGDRLCGMLTKLDGPFAVCHDTLDPRPFLEQCVYDLCVVGGERLSLCRGLSAYAQACLELGISVGDWRSPANCPLSCPANSRYELCGPACPTSCNGAAAPSNCSGRPCVEGCVCLPGFVASGGACVPASSCGCTFQGLQLAPGQEVWADELCQRRCTCNGATHQVTCRDKQSCPAGERCSVQNGLLGCYPDRFGTCQGSGDPHYVSFDGRRFDFMGTCTYLLVGSCGQNAALPAFRVLVENEHRGSQTVSYTRAVRVEARGVKVAVRREYPGQVLVDDVLQYLPFQAADGQVQVFRQGRDAVVRTDFGLTVTYDWNARVTAKVPSSYAEALCGLCGNFNGDPADDLALRGGGQAANALAFGNSWQEETRPGCGATEPGDCPKLDSLVAQQLQSKNECGILADPKGPFRECHSKLDPQGAVRDCVYDRCLLPGQSGPLCDALATYAAACQAAGATVHPWRSEELCPLSCPPHSHYEACSYGCPLSCGDLPVPGGCGSECHEGCVCDEGFALSGESCLPLASCGCVHQGTYHPPGQTFYPGPGCDSLCHCQEGGLVSCESSSCGPHEACQPSGGSLGCVAVGSSTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQQMCGLCGNYNGDPKDDFQKPNGSQAGNANEFGNSWEEVVPDSPCLPPTPCPPGSEDCIPSHKCPPELEKKYQKEEFCGLLSSPTGPLSSCHKLVDPQGPLKDCIFDLCLGGGNLSILCSNIHAYVSACQAAGGHVEPWRTETFCPMECPPNSHYELCADTCSLGCSALSAPPQCQDGCAEGCQCDSGFLYNGQACVPIQQCGCYHNGVYYEPEQTVLIDNCRQQCTCHAGKGMVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGSPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFNFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSEGCIPSEECPPELEKKYQKEEFCGLLSSPTGPLSSCHKLVDPQGPLKDCIFDLCLGGGNLSILCSNIHAYVSACQAAGGQVEPWRNETFCPMECPQNSHYELCADTCSLGCSALSAPLQCPDGCAEGCQCDSGFLYNGQACVPIQQCGCYHNGAYYEPEQTVLIDNCRQQCTCHVGKVVVCQEHSCKPGQVCQPSGGILSCVNKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGHRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSAGCIPSDKCPPELEKKYQKEEFCGLLSSPTGPLSSCHKLVDPQGPLKDCIFDLCLGGGNLSILCSNIHAYVSACQAAGGHVEPWRNETFCPMECPQNSHYELCADTCSLGCSALSAPLQCPDGCAEGCQCDSGFLYNGQACVPIQQCGCYHNGVYYEPEQTVLIDNCRQQCTCHVGKVVVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVAQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLSSGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVALPFQLDSLLHAHLSGADVVVTTTSGLSLAFDGDSFVRLRVPAAYAASLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLGEWRRPDFCPLQCPAHSHYELCGDSCPVSCPSLSAPEGCESACREGCVCDAGFVLSGDTCVPVGQCGCLHDGRYYPLGEVFYPGPECERRCECGPGGHVTCQEGAACGPHEECRLEDGVQACHATGCGRCLANGGIHYITLDGRVYDLHGSCSYVLAQVCHPKPGDEDFSIVLEKNAAGDLQRLLVTVAGQVVSLAQGQQVTVDGEAVALPVAVGRVRVTAEGRNMVLQTTKGLRLLFDGDAHLLMSIPSPFRGRLCGLCGNFNGNWSDDFVLPNGSAASSVETFGAAWRAPGSSKGCGEGCGPQGCPVCLAEETAPYESNEACGQLRNPQGPFATCQAVLSPSEYFRQCVYDLCAQKGDKAFLCRSLAAYTAACQAAGVAVKPWRTDSFCPLHCPAHSHYSICTRTCQGSCAALSGLTGCTTRCFEGCECDDRFLLSQGVCIPVQDCGCTHNGRYLPVNSSLLTSDCSERCSCSSSSGLTCQAAGCPPGRVCEVKAEARNCWATRGLCVLSVGANLTTFDGARGATTSPGVYELSSRCPGLQNTIPWYRVVAEVQICHGKTEAVGQVHIFFQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPCYG

SEQ ID NO: 1849 - protein, 352 aa, Homo sapiens
MAPKLITVLCLGFCLNQKICPHAGAQDKFSLSAWPSPVVPLGGRVTLSCHSHLRFVIWTIFQTTGTRSHELHTGLSNNITISPVTPEHAGTYRCVGIYKHASKWSAESNSLKIIVTGLFTKPSISAHPSSLVHAGARVSLRCHSELAFDEFILYKEGHIQHSQQLDQGMEAGIHYVEAVFSMGPVTPAHAGAYRCCGCFSHSRYEWSAPSDPLDIVITGKYKKPSLSTQVDPMMRLGEKLTLFCSSEISFDQYHLFRHGVAHGQWLSGGQRHREAFQANFSVGRATPVPGGTYRCYGSFNDSPYKPPVTRCNFTPQETLRVLLCHSQNPPLNLTHLALKDSPATCICSLDSQ

SEQ ID NO: 1850 - protein, 360 aa, Homo sapiens
MPELVVTALLAPSRLSLKLLRAFMWSLVFSVALVAAAVYGCIALTHVLCRPRRGCCGRRRSASPACLSDPSLGEHGFLNLKSSGLRLHYVSAGRGNGPLMLFLHGFPENWFSWRYQLREFQSRFHVVAVDLRGYGPSDAPRDVDCYTIDLLLVDIKDVILGLGYSKCILVAHDWGALLAWHFSIYYPSLVERMVVVSGAPMSVYQDYSLHHISQFFRSHYMFLFQLPWLPEKLLSMSDFQILKTTLTHRKTGIPCLTPSELEAFLYNFSQPGGLTGPLNYYRNLFRNFPLEPQELTTPTLLLWGEKDTYLELGLVEAIGSRFVPGRLEAHILPGIGHWIPQSNPQEMHQYMWAFLQDLLD

SEQ ID NO: 1851 - protein, 365 aa, Homo sapiens
MDRAALLGLARLCALWAALLVLFPYGAQGNWMWLGIASFGVPEKLGCANLPLNSRQKELCKRKPYLLPSIREGARLGIQECGSQFRHERWNCMITAAATTAPMGASPLFGYELSSGTKETAFIYAVMAAGLVHSVTRSCSAGNMTECSCDTTLQNGGSASEGWHWGGCSDDVQYGMWFSRKFLDFPIGNTTGKENKVLLAMNLHNNEAGRQAVAKLMSVDCRCHGVSGSCAVKTCWKTMSSFEKIGHLLKDKYENSIQISDKTKRKMRRREKDQRKIPIHKDDLLYVNKSPNYCVEDKKLGIPGTQGRECNRTSEGADGCNLLCCGRGYNTHVVRHVERCECKFIWCCYVRCRRCESMTDVHTCK

SEQ ID NO: 1852 - protein, 196 aa, Homo sapiens [sequence omitted]

SEQ ID NO: 1853 - protein, 1158 aa, Homo sapiens
MAAVRGAPLLSCLLALLALCPGGRPQTVLTDDEIEEFLEGFLSELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYEDFEYIRRQKQPRPPPSRRRRPERVWPEPPEEKAPAPAPEERIEPPVKPLLPPLPPDYGDGYVIPNYDDMDYYFGPPPPQKPDAERQTDEEKEELKKPKKEDSSPKEETDKWAVEKGKDHKEPRKGEELEEEWTPTEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 1854 - protein, 478 aa, Homo sapiens
MAHVPARTSPGPGPQLLLLLLPLFLLLLRDVAGSHRAPAWSALPAAADGLQGDRDLQRHPGDAAATLGPSAQDMVAVHMHRLYEKYSRQGARPGGGNTVRSFRARLEVVDQKAVYFFNLTSMQDSEMILTATFHFYSEPPRWPRALEVLCKPRAKNASGRPLPLGPPTRQHLLFRSLSQNTATQGLLRGAMALAPPPRGLWQAKDISPIVKAARRDGELLLSAQLDSEERDPGVPRPSPYAPYILVYANDLAISEPNSVAVTLQRYDPFPAGDPEPRAAPNNSADPRVRRAAQATGPLQDNELPGLDERPPRAHAQHFHKHQLWPSPFRALKPRPGRKDRRKKGQEVFMAASQVLDFDEKTMQKARRKQWDEPRVCSRRYLKVDFADIGWNEWIISPKSFDAYYCAGACEFPMPKIVRPSNHATIQSIVRAVGIIPGIPEPCCVPDKMNSLGVLFLDENRNVVLKVYPNMSVDTCACR

SEQ ID NO: 1855 - protein, 134 aa, Homo sapiens
MKSLTWILGLWALAACFTPGESQRGPRGPYPPGPLAPPPPPCFPFGTGFVPPPHPPPYGPGRFPPPLSPPYGPGRIPPSPPPPYGPGRIQSHSLPPPYGPGYPQPPSQPRPYPPGPPFFPVNSPTDPALPTPAP

SEQ ID NO: 1856 - protein, 329 aa, Homo sapiens
MVSKSRWKLLAMLALVLVVMVWYSISREDSFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 1857 - protein, 369 aa, Homo sapiens
MRACISLVLAVLCGLAWAEDHKESEPLPQLEEETEEALASNLYSAPTSCQGRCYEAFDKHHQCHCNARCQEFGNCCKDFESLCSDHEVSHSSDAITKEEIQSISEKIYRADTNKAQKEDIVLNSQNCISPSETRNQVDRCPKPLFTYVNEKLFSKPTYAAFINLLNNYQRATGHGEHFSAQELAEQDAFLREIMKTAVMKELYSFLHHQNRYGSEQEFVDDLKNMWFGLYSRGNEEGDSSGFEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 1858 - protein, 543 aa, Homo sapiens
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 1859 - protein, 201 aa, Homo sapiens
MARDYDHLFKLLIIGDSGVGKSSLLLRFADNTFSGSYITTIGVDFKIRTVEINGEKVKLQIWDTAGQERFRTITSTYYRGTHGVIVVYDVTSAESFVNVKRWLHEINQNCDDVCRILVGNKNDDPERKVVETEDAYKFAGQMGIQLFETSAKENVNVEEMFNCITELVLRAKKDNLAKQQQQQQNDVVKLTKNSKRKKRCC

SEQ ID NO: 1860 - protein, 477 aa, Homo sapiens
MTSKFLLVSFILAALSLSTTFSLQPDQQKVLLVSFDGFRWDYLYKVPTPHFHYIMKYGVHVKQVTNVFITKTYPNHYTLVTGLFAENHGIVANDMFDPIRNKSFSLDHMNIYDSKFWEEATPIWITNQRAGHTSGAAMWPGTDVKIHKRFPTHYMPYNESVSFEDRVAKIIEWFTSKEPINLGLLYWEDPDDMGHHLGPDSPLMGPVISDIDKKLGYLIQMLKKAKLWNTLNLIITSDHGMTQCSEERLIELDQYLDKDHYTLIDQSPVAAILPKEGKFDEVYEALTHAHPNLTVYKKEDVPERWHYKYNSRIQPIIAVADEGWHILQNKSDDFLLGNHGYDNALADMHPIFLAHGPAFRKNFSKEAMNSTDLYPLLCHLLNITAMPHNGSFWNVQDLLNSAMPRVVPYTQSTILLPGSVKPAEYDQEGSYPYFIGVSLGSIIVIVFFVIFIKHLIHSQIPALQDMHAEIAQPLLQA

SEQ ID NO: 1861 - protein, 162 aa, Homo sapiens
MKGFTATLFLWTLIFPSCSGGGGGKAWPTHVVCSDSGLEVLYQSCDPLQDFGFSVEKCSKQLKSNINIRFGIILREDIKELFLDLALMSQGSSVLNFSYPICEAALPKFSFCGRRKGEQIYYAGPVNNPEFTIPQGEYQVLLELYTEKRSTVACANATIMCS

SEQ ID NO: 1862 - protein, 264 aa, Homo sapiens
MTKFSSFSLFFLIVGAYMTHVCFNMEIIGGKEVSPHSRPFMASIQYGGHHVCGGVLIDPQWVLTAAHCQYRFTKGQSPTVVLGAHSLSKNEASKQTLEIKKFIPFSRVTSDPQSNDIMLVKLQTAAKLNKHVKMLHIRSKTSLRSGTKCKVTGWGATDPDSLRPSDTLREVTVTVLSRKLCNSQSYYNGDPFITKDMVCAGDAKGQKDSCKGDSGGPLICKGVFHAIVSGGHECGVATKPGIYTLLTKKYQTWIKSNLVPPHTN

SEQ ID NO: 1863 - protein, 246 aa, Homo sapiens
MLWRQLIYWQLLALFFLPFCLCQDEYMESPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 1864 - protein, 782 aa, Homo sapiens
MAPSAWAICWLLGGLLLHGGSSGPSPGPSVPRLRLSYRDLLSANRSAIFLGPQGSLNLQAMYLDEYRDRLFLGGLDALYSLRLDQAWPDPREVLWPPQPGQREECVRKGRDPLTECANFVRVLQPHNRTHLLACGTGAFQPTCALITVGHRGEHVLHLEPGSVESGRGRCPHEPSRPFASTFIDGELYTGLTADFLGREAMIFRSGGPRPALRSDSDQSLLHDPRFVMAARIPENSDQDNDKVYFFFSETVPSPDGGSNHVTVSRVGRVCVNDAGGQRVLVNKWSTFLKARLVCSVPGPGGAETHFDQLEDVFLLWPKAGKSLEVYALFSTVSAVFQGFAVCVYHMADIWEVFNGPFAHRDGPQHQWGPYGGKVPFPRPGVCPSKMTAQPGRPFGSTKDYPDEVLQFARAHPLMFWPVRPRHGRPVLVKTHLAQQLHQIVVDRVEAEDGTYDVIFLGTDSGSVLKVIALQAGGSAEPEEVVLEELQVFKVPTPITEMEISVKRQMLYVGSRLGVAQLRLHQCETYGTACAECCLARDPYCAWDGASCTHYRPSLGKRRFRRQDIRHGNPALQCLGQSQEEEAVGLVAATMVYGTEHNSTFLECLPKSPQAAVRWLLQRPGDEGPDQVKTDERVLHTERGLLFRRLSRFDAGTYTCTTLEHGFSQTVVRLALVVIVASQLDNLFPPEPKPEEPPARGGLASTPPKAWYKDILQLIGFANLPRVDEYCERVWCRGTTECSGCFRSRSRGKQARGKSWAGLELGKKMKSRVHAEHNRTPREVEAT

SEQ ID NO: 1865 - protein, 350 aa, Homo sapiens
MEPKRIREGYLVKKGSVFNTWKPMWVVLLEDGIEFYKKKSDNSPKGMIPLKGSTLTSPCQDFGKRMFVFKITTTKQQDHFFQAAFLEERDAWVRDIKKAIKCIEGGQKFARKSTRRSIRLPETIDLGALYLSMKDTEKGIKELNLEKDKKIFNHCFTGNCVIDWLVSNQSVRNRQEGLMIASSLLNEGYLQPAGDMSKSAVDGTAENPFLDNPDAFYYFPDSGFFCEENSSDDDVILKEEFRGVIIKQGCLLKQGHRRKNWKVRKFILREDPAYLHYYDPAGAEDPLGAIHLRGCVVTSVESNSNGRKSEEENLFEIITADEVHYFLQAATPKERTEWIRAIQMASRTGK

SEQ ID NO: 1866 - protein, 491 aa, Homo sapiens
MKTFTWTLGVLFFLLVDTGHCRGGQFKIKKINQRRYPRATDGKEEAKKCAYTFLVPEQRITGPICVNTKGQDASTIKDMITRMDLENLKDVLSRQKREIDVLQLVVDVDGNIVNEVKLLRKESRNMNSRVTQLYMQLLHEIIRKRDNSLELSQLENKILNVTTEMLKMATRYRELEVKYASLTDLVNNQSVMITLLEEQCLRIFSRQDTHVSPPLVQVVPQHIPNSQQYTPGLLGGNEIQRDPGYPRDLMPPPDLATSPTKSPFKIPPVTFINEGPFKDCQQAKEAGHSVSGIYMIKPENSNGPMQLWCENSLDPGGWTVIQKRTDGSVNFFRNWENYKKGFGNIDGEYWLGLENIYMLSNQDNYKLLIELEDWSDKKVYAEYSSFRLEPESEFYRLRLGTYQGNAGDSMMWHNGKQFTTLDRDKDMYAGNCAHFHKGGWWYNACAHSNLNGVWYRGGHYRSKHQDGIFWAEYRGGSYSLRAVQMMIKPID

SEQ ID NO: 1867 - protein, 376 aa, Homo sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 1868 - protein, 523 aa, Homo sapiens
MARKALKLASWTSMALAASGIYFYSNKYLDPNDFGAVRVGRAVATTAVISYDYLTSLKSVPYGSEEYLQLRSKVHLRSARRLCELCCANRGTFIKVGQHLGALDYLLPEEYTSTLKVLHSQAPQSSMQEIRQVIREDLGKEIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKVPRIHWDLSTERVLLMEFVDGGQVNDRDYMERNKIDVNEISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATEDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 1869 - protein, 398 aa, Homo sapiens
MWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 1870 - protein, 184 aa, Homo sapiens
MRGQGRKESLSDSRDLDGSYDQLTDSVDDEFELSTVCHRPEGLEQLQEQTKFTRKELQVLYRGFKNECPSGIVNEENFKQIYSQFFPQGDSSTYATFLFNAFDTNHDGSVSFEEMLDIMKSIYDMMGKYTYPALREEAPREHVESFFQKMDRNKDGVVTIEEFIESCQKVQLPALYITLTWTQA

SEQ ID NO: 1871 - protein, 1299 aa, Homo sapiens
MSLQEMFRFPMGLLLGSVLLVASAPATLEPPGCSNKEQQVTVSHTYKIDVPKSALVQVDADPQPLSDDGASLLALGEAREEQNIIFRHNIRLQTPQKDCELAGSVQDLLARVKKLEEEMVEMKEQCSAQRCCQGVTDLSRHCSGHGTFSLETCSCHCEEGREGPACERLACPGACSGHGRCVDGRCLCHEPYVGADCGYPACPENCSGHGECVRGVCQCHEDFMSEDCSEKRCPGDCSGHGFCDTGECYCEEGFTGLDCAQVVTPQGLQLLKNTEDSLLVSWEPSSQVDHYLLSYYPLGKELSGKQIQVPKEQHSYEILGLLPGTKYIVTLRNVKNEVSSSPQHLLATTDLAVLGTAWVTDETENSLDVEWENPSTEVDYYKLRYGPMTGQEVAEVTVPKSSDPKSRYDITGLHPGTEYKITVVPMRGELEGKPILLNGRTEIDSPTNVVTDRVTEDTATVSWDPVQAVIDKYVVRYTSADGDTKEMAVHKDESSTVLTGLKPGEAYKVYVWAERGNQGSKKADTNALTEIDSPANLVTDRVTENTATISWDPVQATIDKYVVRYTSADDQETREVLVGKEQSSTVLTGLRPGVEYTVHVWAQKGDRESKKADTNAPTDIDSPKNLVTDRVTENMATVSWDPVQAAIDKYVVRYTSAGGETREVPVGKEQSSTVLTGLRPGMEYMVHVWAQKGDQESKKADTKAQTDIDSPQNLVTDRVTENMATVSWDPVRATIDRYVVRYTSAKDGETREVPVGKEQSSTVLTGLRPGVEYTVHVWAQKGAQESKKADTKAQTDIDSPQNLVTDWVTENTATVSWDPVQATIDRYVVHYTSANGETREVPVGKEQSSTVLTGLRPGMEYTVHVWAQKGNQESKKADTKAQTEIDGPKNLVTDWVTENMATVSWDPVQATIDKYMVRYTSADGETREVPVGKEHSSTVLTGLRPGMEYMVHVWAQKGAQESKKADTKAQTELDPPRNLRPSAVTQSGGILTWTPPSAQIHGYILTYQFPDGTVKEMQLGREDQRFALQGLEQGATYPVSLVAFKGGRRSRNVSTTLSTVGARFPHPSDCSQVQQNSNAASGLYTIYLHGDASRPLQVYCDMETDGGGWIVFQRRNTGQLDFFKRWRSYVEGFGDPMKEFWLGLDKLHNLTTGTPARYEVRVDLQTANESAYAIYDFFQVASSKERYKLTVGKYRGTAGDALTYHNGWKFTTFDRDNDIALSNCALTHHGGWWYKNCHLANPNGRYGETKHSEGVNWEPWKGHEFSIPYVELKIRPHGYSREPVLGRKKRTLRGRLRTF

SEQ ID NO: 1872 - protein, 553 aa, Homo sapiens
MTRGGPGGRPGLPQPPPLLLLLLLLPLLLVTAEPPKPAGVYYATAYWMPAEKTVQVKNVMDKNGDAYGFYNNSVKTTGWGILEIRAGYGSQTLSNEIIMFVAGFLEGYLTAPHMNDHYTNLYPQLITKPSIMDKVQDFMEKQDKWTRKNIKEYKTDSFWRHTGYVMAQIDGLYVGAKKRAILEGTKPMTLFQIQFLNSVGDLLDLIPSLSPTKNGSLKVFKRWDMGHCSALIKVLPGFENILFAHSSWYTYAAMLRIYKHWDFNVIDKDTSSSRLSFSSYPGFLESLDDFYILSSGLILLQTTNSVFNKTLLKQVIPETLLSWQRVRVANMMADSGKRWADIFSKYNSGTYNNQYMVLDLKKVKLNHSLDKGTLYIVEQIPTYVEYSEQTDVLRKGYWPSYNVPFHEKIYNWSGYPLLVQKLGLDYSYDLAPRAKIFRRDQGKVTDTASMKYIMRYNNYKKDPYSRGDPCNTICCREDLNSPNPSPGGCYDTKVADIYLASQYTSYAISGPTVQGGLPVFRWDRFNKTLHQGMPEVYNFDFITMKPILKLDIK

SEQ ID NO: 1873 - protein, 756 aa, Homo sapiens
MSRPGTATPALALVLLAVTLAGVGAQGAALEDPDYYGQEIWSREPYYARPEPELETFSPPLPAGPGEEWERRPQEPRPPKRATKPKKAPKREKSAPEPPPPGKHSNKKVMRTKSSEKAANDDHSVRVAREDVRESCPPLGLETLKITDFQLHASTVKRYGLGAHRGRLNIQAGINENDFYDGAWCAGRNDLQQWIEVDARRLTRFTGVITQGRNSLWLSDWVTSYKVMVSNDSHTWVTVKNGSGDMIFEGNSEKEIPVLNELPVPMVARYIRINPQSWFDNGSICMRMEILGCPLPDPNNYYHRRNEMTTTDDLDFKHHNYKEMRQLMKVVNEMCPNITRIYNIGKSHQGLKLYAVEISDHPGEHEVGEPEFHYIAGAHGNEVLGRELLLLLVQFVCQEYLARNARIVHLVEETRIHVLPSLNPDGYEKAYEGGSELGGWSLGRWTHDGIDINNNFPDLNTLLWEAEDRQNVPRKVPNHYIAIPEWFLSENATVAAETRAVIAWMEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTANDGDYWRLLNPGEYVVTAKAEGFTASTKNCMVGYDMGATRCDFTLSKTNMARIREIMEKFGKQPVSLPARRLKLRGQKRRQRG

SEQ ID NO: 1874 - protein, 233 aa, Homo sapiens
MATPPFRLIRKMFSFKVSRWMGLACFRSLAASSPSIRQKKLMHKLQEEKAFREEMKIFREKIEDFREEMWTFRGKIHAFRGQILGFWEEERPFWEEEKTFWKEEKSFWEMEKSFREEEKTFWKKYRTFWKEDKAFWKEDNALWERDRNLLQEDKALWEEEKALWVEERALLEGEKALWEDKTSLWEEENALWEEERAFWMENNGHIAGEQMLEDGPHNANRGQRLLAFSRGRA

SEQ ID NO: 1875 - protein, 231 aa, Homo sapiens
MMLSCLFLLKALLALGSLESWITAGEHAKEGECPPHKNPCKELCQGDELCPAEQKCCTTGCGRICRDIPKGRKRDCPRVIRKQSCLKRCITDETCPGVKKCCTLGCNKSCVVPISKQKLAEFGGECPADPLPCEELCDGDASCPQGHKCCSTGCGRTCLGDIEGGRGGDCPKVLVGLCIVGCVMDENCQAGEKCCKSGCGRFCVPPVLPPKLTMNPNWTVRSDSELEIPVP

SEQ ID NO: 1876 - protein, 349 aa, Homo sapiens
MGPISAPSCRWRIPWQGLLLTASLFTFWNPPTTAQLTIEAVPSNAAEGKEVLLLVHNLPQDPRGYNWYKGETVDANRRIIGYVISNQQITPGPAYSNRETIYPNASLLMRNVTRNDTGSYTLQVIKLNLMSEEVTGQFSVHPETPKPSISSNNSNPVEDKDAVAFTCEPETQNTTYLWWVNGQSLPVSPRLQLSNGNRTLTLLSVTRNDVGPYECEIQNPASANFSDPVTLNVLYGPDAPTISPSDTYYHAGVNLNLSCHAASNPPSQYSWSVNGTFQQYTQKLFIPNITTKNSGSYACHTTNSATGRNRTTVRMITVSDALVQGSSPGLSARATVSIMIGVLARVALI

SEQ ID NO: 1877 - protein, 169 aa, Homo sapiens
MTAGRRMEMLCAGRVPALLLCLGFHLLQAVLSTTVIPSCIPGESSDNCTALVQTEDNPRVAQVSITKCSSDMNGYCLHGQCIYLVDMSQNYCRCEVGYTGVRCEHFFLTVHQPLSKEYVALTVILIILFLITVVGSTYYFCRWYRNRKSKEPKKEYERVTSGDPELPQV

SEQ ID NO: 1878 - protein, 90 aa, Homo sapiens
MKLSVCLLLVTLALCCYQANAEFCPALVSELLDFFFISEPLFKLSLAKFDAPPEAVAAKLGVKRCTDQMSLQKRSLIAEVLVKILKKCSV

SEQ ID NO: 1879 - protein, 142 aa, Homo sapiens
MPRCRWLSLILLTIPLALVARKDPKKNETGVLRKLKPVNASNANVKQCLWFAMQEYNKESEDKYVFLVVKTLQAQLQVTNLLEYLIDVEIARSDCRKPLSTNEICAIQENSKLKRKLSCSFLVGALPWNGEFTVMEKKCEDA

SEQ ID NO: 1880 - protein, 145 aa, Homo sapiens
MGIGCWRNPLLLLIALVLSAKLGHFQRWEGFQQKLMSKKNMNSTLNFFIQSYNNASNDTYLYRVQRLIRSQMQLTTGVEYIVTVKIGWTKCKRNDTSNSSCPLQSKKLRKSLICESLIYTMPWINYFQLWNNSCLEAEHVGRNLR

SEQ ID NO: 1881 - protein, 183 aa, Homo sapiens
MKLLFPIFASLMLQYQVNTEFIGLRRCLMGLGRCRDHCNVDEKEIQKCKMKKCCVGPKVVKLIKNYLQYGTPNVLNEDVQEMLKPAKNSSAVIQRKHILSVLPQIKSTSFFANTNFVIIPNATPMNSATISTMTPGQITYTATSTKSNTKESRDSATASPPPAPPPPNILPTPSLELEEAEEQ

SEQ ID NO: 1882 - protein, 202 aa, Homo sapiens
MRGHPSLLLLYMALTTCLDTSPSEETDQEVFLGPPEAQSFLSSHTRIPRANHWDLELLTPGNLERECLEERCSWEEAREYFEDNTLTERFWESYIYNGKGGRGRVDVASLAVGLTGGILLIVLAGLGAFWYLRWRQHRGQQPCPQEAGLISPLSPLNPLGPPTPLPPPPPPPPGLPTYEQALAASGVHDAPPPPYTSLRRPH

SEQ ID NO: 1883 - protein, 185 aa, Homo sapiens
MRLLILTCLVAVALARPKLPLRYPERLQNPSESSEPIPLESREEYMNGMNRQRNILREKQTDEIKDTRNESTQNCVVAEPEKMESSISSSSEEMSLSKCAEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 1884 - protein, 469 aa, Homo sapiens
MITEGAQAPRLLLPPLLLLLTLPATGSDPVLCFTQYEESSGKCKGLLGGGVSVEDCCLNTAFAYQKRSGGLCQPCRSPRWSLWSTWAPCSVTCSEGSQLRYRRCVGWNGQCSGKVAPGTLEWQLQACEDQQCCPEMGGWSGWGPWEPCSVTCSKGTRTRRRACNHPAPKCGGHCPGQAQESEACDTQQVCPTHGAWATWGPWTPCSASCHGGPHEPKETRSRKCSAPEPSQKPPGKPCPGLAYEQRRCTGLPPCPVAGGWGPWGPVSPCPVTCGLGQTMEQRTCNHPVPQHGGPFCAGDATRTHICNTAVPCPVDGEWDSWGEWSPCIRRNMKSISCQEIPGQQSRGRTCRGRKFDGHRCAGQQQDIRHCYSIQHCPLKGSWSEWSTWGLCMPPCGPNPTRARQRLCTPLLPKYPPTVSMVEGQGEKNVTFWGRPLPRCEELQGQKLVVEEKRPCLHVPACKDPEEEEL

SEQ ID NO: 1885 - protein, 150 aa, Homo sapiens
MLIATSFFLFFSSVVAAPTHSSFWQFQRRVKHITGRSAFFSYYGYGCYCGLGDKGIPVDDTDSPSSPSPYEKLKEFSCQPVLNSYQFHIVNGAVVCGCTLGPGASCHCRLKACECDKQSVHCFKESLPTYEKNFKQFSSQPRCGRHKPWC

SEQ ID NO: 1886 - protein, 448 aa, Homo sapiens
MRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 1887 - protein, 313 aa, Homo sapiens
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKFKKLKSLDLQQNEISKIESEAFFGLNKLTTLLLQHNQIKVLTEEVFIYTPLLSYLRLYDNPWHCTCEIETLISMLQIPRNRNLGNYAKCESPQEQKNKKLRQIKSEQLCNEEEKEQLDPKPQVSGRPPVIKPEVDSTFCHNYVFPIQTLDCKRKELKKVPNNIPPDIVKLDLSYNKINQLRPKEFEDVHELKKLNLSSNGIEFIDPGSLR

SEQ ID NO: 1888 - protein, 323 aa, Homo sapiens
MQAAWLLGALVVPQLLGFGHGARGAEREWEGGWGGAQEEEREREALMLKHLQEALGLPAGRGDENPAGTVEGKEDWEMEEDQGEEEEEEATPTPSSGPSPSPTPEDIVTYILGRLAGLDAGLHQLHVRLHALDTRVVELTQGLRQLRNAAGDTRDAVQALQEAQGRAEREHGRLEGCLKGLRLGHKCFLLSRDFEAQAAAQARCTARGGSLAQPADRQQMEALTRYLRAALAPYNWPVWLGVHDRRAEGLYLFENGQRVSFFAWHRSPRPELGAQPSASPHPLSPDQPNGGTLENCVAQASDDGSWWDHDCQRRLYYVCEFPF

SEQ ID NO: 1889 - protein, 361 aa, Homo sapiens
MNGLSLSELCCLFCCPPCPGRIAAKLAFLPPEATYSLVPEPEPGPGGAGAAPLGTLRASSGAPGRWKLHLTERADFQYSQRELDTIEVFPTKSARGNRVSCMYVRCVPGARQGHQAQGGHPQLAWVGRLGDSNNPAPGGCLLGKSWGTGAALACGYIHLLARYTVLFSHGNAVDLGQMSSFYIGLGSRLHCNIFSYDYSGYGASSGRPSERNLYADIDAAWQALRTRYGISPDSIILYGQSIGTVPTVDLASRYECAAVVLHSPLTSGMRVAFPDTKKTYCFDAFPNIEKVSKITSPVLIIHGTEDEVIDFSHGLALYERCPKAVEPLWVEGAGHNDIELYSQYLERLRRFISQELPSQRA

SEQ ID NO: 1890 - protein, 467 aa, Homo sapiens
MRTAPSLRRCVCLLLAAILDLARGYLTVNIEPLPPVVAGDAVTLKCNFKTDGRMREIVWYRVTDGGTIKQKIFTFDAMFSTNYSHMENYRKREDLVYQSTVRLPEVRISDNGPYECHVGIYDRATREKVVLASGNIFLNVMAPPTSIEVVAADTPAPFSRYQAQNFTLVCIVSGGKPAPMVYFKRDGEPIDAVPLSEPPAASSGPLQDSRPFRSLLHRDLDDTKMQKSLSLLDAENRGGRPYTERPSRGLTPDPNILLQPTTENIPETVVSREFPRWVHSAEPTYFLRHSRTPSSDGTVEVRALLTWTLNPQIDNEALFSCEVKHPALSMPMQAEVTLVAPKGPKIVMTPSRARVGDTVRILVHGFQNEVFPEPMFTWTRVGSRLLDGSAEFDGKELVLERVPAELNGSMYRCTAQNPLGSTDTHTRLIVFENPNIPRGTEDSNGSIGPTGARLTLVLALTVILELT

SEQ ID NO: 1891 - protein, 260 aa, Homo sapiens
MARPGMERWRDRLALVTGASGGIGAAVARALVQQGLKVVGCARTVGNIEELAAECKSAGYPGTLIPYRCDLSNEEDILSMFSAIRSQHSGVDICINNAGLARPDTLLSGSTSGWKDMFNVNVLALSICTREAYQSMKERNVDDGHIININSMSGHRVLPLSVTHFYSATKYAVTALTEGLRQELREAQTHIRATCISPGVVETQFAFKLHDKDPEKAAATYEQMKCLKPEDVAEAVIYVLSTPAHIQIGDIQMRPTEQVT

SEQ ID NO: 1892 - protein, 405 aa, Homo sapiens
MSSPALTAGASGKVMDFNNGTYLVSFTLFWEGQVSLSLLLIHPSEGASALWRARNQGYDKIIFKGKFVNGTSHVFTECGLTLNSNAELCEYLDDRDQEAFYCMKPQHMPCEALTYMTTRNREVSYLTDKENSLFHRSKVGVEMMKDRKHIDVTNCNKREKIEETCQVGMKPPVPGGYTLQGKWITTFCNQVQLDTIKINGCLKGKLIYLLGDSTLRQWIYYFPKVVKTLKFFDLHETGIFKKHLLLDAERHTQIQWKKHSYPFVTFQLYSLIDHDYIPREIDRLSGDKNTAIVITFGQHFRPFPIDIFIRRAIGVQKAIERLFLRSPATKVIIKTENIREMHIETERFGDFHGYIHYLIMKDIFKDLNVGIIDAWDMTIAYGTDTIHPPDHVIGNQINMFLNYIC

SEQ ID NO: 1893 - protein, 198 aa, Homo sapiens
MPVPALCLLWALAMVTRPASAAPMGGPELAQHEELTLLFHGTLQLGQALNGVYRTTEGRLTKARNSLGLYGRTIELLGQEVSRGRDAAQELRASLLETQMEEDILQLQAEATAEVLGEVAQAQKVLRDSVQRLEVQLRSAWLGPAYREFEVLKAHADKQSHILWALTGHVQRQRREMVAQQHRLRQIQERLHTAALPA

SEQ ID NO: 1894 - protein, 484 aa, Homo sapiens
MAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSASGPTRLVLSDCATSHGSLRIQLLHKLSFLVNALAKQVMNLLVPSLPNLVKNQLCPVIEASFNGMYADLLQLVKVPISLSIDRLEFDLLYPAIKGDTIQLYLGAKLLDSQGKVTKWFNNSAASLTMPTLDNIPFSLIVSQDVVKAAVAAVLSPEEFMVLLDSVLPESAHRLKSSIGLINEKAADKLGSTQIVKILTQDTPEFFIDQGHAKVAQLIVLEVFPSSEALRPLFTLGIEASSEAQFYTKGDQLILNLNNISSDRIQLMNSGIGWFQPDVLKNIITEIIHSILLPNQNGKLRSGVPVSLVKALGFEAAESSLTKDALVLTPASLWKPSSPVSQ

SEQ ID NO: 1895 - protein, 249 aa, Homo sapiens
MLQLWKLVLLCGVLTGTSESLLDNLGNDLSNVVDKLEPVLHEGLETVDNTLKGILEKLKVDLGVLQKSSAWQLAKQKAQEAEKLLNNVISKLLPTNTDIFGLKISNSLILDVKAEPIDDGKGLNLSFPVTANVTVAGPIIGQIINLKASLDLLTAVTIETDPQTHQPVAVLGECASDPTSISLSLLDKHSQIINKFVNSVINTLKSTVSSLLQKEICPLIRIFIHSLDVNVIQQVVDNPQHKTQLQTLI

SEQ ID NO: 1896 - protein, 652 aa, Homo sapiens
MQGPLLLPGLCFLLSLFGAVTQKTKTSCAKCPPNASCVNNTHCTCNHGYTSGSGQKLFTFPLETCNDINECTPPYSVYCGFNAVCYNVEGSFYCQCVPGYRLHSGNEQFSNSNENTCQDTTSSKTTEGRKELQKIVDKFESLLTNQTLWRTEGRQEISSTATTILRDVESKVLETALKDPEQKVLKIQNDSVAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 1897 - protein, 420 aa, Homo sapiens
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 1898 - protein, 430 aa, Homo sapiens
MAWTFECSRTTSPEPLSTSPCRTTSSRNSPTMSCPASVACEPSTSTTTSSPPKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 1899 - protein, 1053 aa, Homo sapiens
MWQPRRPWPRVPWRWALALLALVGAGLCHAGPQPGYPARPSARNKNWCAYIVNKNVSCSVLEGSESFIQAQYNCAWNQMPCPSALVYRVNFRPRYVTRYKTVTQLEWRCCPGFRGGDCQEGPKDPVKTLRPTPARPRNSLKKATDNEPSQFSEPRKTLSPTGTAQPSWGVDPKEGPQELQEKKIQVLEEKVLRLTRTVLDLQSSLAGVSENLKHATQDDASRTRAPGLSSQHPKPDTTVSGDTETGQSPGVFNTKESGMKDIKSELAEVKDTLKNKSDKLEELDGKVKGYEGQLRQLQEAAQGPTVTMTTNELYQAYVDSKIDALREELMEGMDRKLADLKNSCEYKLTGLQQQCDDYGSSYLGVIELIGEKETSLRKEINNLRARLQEPSAQANCCDSEKNGDIGQQIKTLDQKIERVAEATRMLNGRLDNEFDRLIVPEPDVDFDAKWNELDARINVTEKNAEEHCFYIEETLRGAINGEVGDLKQLVDQKIQSLEDRLGSVLLQMTNNTGAELSPPGAAALPGVSGSGDERVMMELNHLKDKVQVVEDICLLNIQGKPHGMEGALPNREDRAVRDSLHLLKSLNDTMHRKFQETEQTIQKLQQDFSFLYSQLNHTENDVTHLQKEMSNCRAGENAGMGRFTKVGEQERTVDTLPSPQHPVAHCCSQLEERWQRLQSQVISELDACKECTQGVQREVSMVEGRVSHMEKTCSKLDSISGNLQRIKEGLNKHVSSLWNCVRQMNGTLRSHSRDISGLKNSVQQFYSHVFQISTDLQDLVKFQPSAKAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 1900 - protein, 515 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEDSQLYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRGSTCLLPSLRPPTQPPTQDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSG

SEQ ID NO: 1901 - protein, 340 aa, Homo sapiens
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 1902 - protein, 229 aa, Homo sapiens
MDLLQFLAFLFVLLLSGMGATGTLRTSLDPSLEIYKKMFEVKRREQLLALKNLAQLNDIHQQYKILDVMLKGLFKVLEDSRTVLTAADVLPDGPFPQDEKLKDAFSHVVENTAFFGDVVLRFPRIVHYYFDHNSNWNLLIRWGISFCNQTGVFNQGPHSPILSLMAQELGISEKDSNFQNPFKIDRTEFIPSTDPFQKALREEEKRRKKEEKRKEIRKGPRISRSQSEL

SEQ ID NO: 1903 - protein, 154 aa, Homo sapiens
MSVGTSLEQAQMSTLTCPLFIPTVGRKTALHSGEDFQTLLFERVFVNLDGCFDMATGQFAAPLRGIYFFSLNVHSWNYKETYVHIMHNQKEAVILYAQPSERSIMQSQSVMLDLAYGDRVWVRLFKRQRENAIYSNDFDTYITFSGHLIKAEDD

SEQ ID NO: 1904 - protein, 299 aa, Homo sapiens
MRSVGEGAREWIRECQHQFRHHRWNCTTLDRDHTVFGRVMLRSSREAAFVYAISSAGVVHAITRACSQGELSVCSCDPYTRGRHHDQRGDFDWGGCSDNIHYGVRFAKAFVDAKEKRLKDARALMNLHNNRCGRTAVRRFLKLECKCHGVSGSCTLRTCWRALSDFRRTGDYLRRRYDGAVQVMATQDGANFTAARQGYRRATRTDLVYFDNSPDYCVLDKAAGSLGTAGRVCSKTSKGTDGCEIMCCGRGYDTTRVTRVTQCECKFHWCCAVRCKECRNTVDVHTCKAPKKAEWLDQT

SEQ ID NO: 1905 - protein, 569 aa, Homo sapiens
MLLLFSVILISWVSTVGGEGTLCDFPKIHHGFLYDEEDYNPFSQVPTGEVFYYSCEYNFVSPSKSFWTRITCTEEGWSPTPKCLRMCSFPFVKNGHSESSGLIHLEGDTVQIICNTGYSLQNNEKNISCVERGWSTPPICSFTKGECHVPILEANVDAQPKKESYKVGDVLKFSCRKNLIRVGSDSVQCYQFGWSPNFPTCKGQVRSCGPPPQLSNGEVKEIRKEEYGHNEVVEYDCNPNFIINGPKKIQCVDGEWTTLPTCVEQVKTCGYIPELEYGYVQPSVPPYQHGVSVEVNCRNEYAMIGNNMITCINGIWTELPMCVATHQLKRCKIAGVNIKTLLKLSGKEFNHNSRIRYRCSDIFRYRHSVCINGKWNPEVDCTEKREQFCPPPPQIPNAQNMTTTVNYQDGEKVAVLCKENYLLPEAKEIVCKDGRWQSLPRCVESTAYCGPPPSINNGDTTSFPLSVYPPGSTVTYRCQSFYKLQGSVTVTCRNKQWSEPPRCLDPCVVSEENMNKNNIQLKWRNDGKLYAKTGDAVEFQCKFPHKAMISSPPFRAICQEGKFEYPICE

SEQ ID NO: 1906 - protein, 116 aa, Homo sapiens
MKGLRSLAATTLALFLVFVFLGNSSCAPQRLLERRNWTPQAMLYLKGAQGRRFISDQSRRKDLSDRPLPERRSPNPQLLTIPEAATILLASLQKSPEDEEKNFDQTRFLEDSLLNW

SEQ ID NO: 1907 - protein, 63 aa, Homo sapiens
MKHVLNLYLLGVVLTLLSIFVRVMESLEGLLESPSPGTSWTTRSQLANTEPTKGLPDHPSRSM

SEQ ID NO: 1908 - protein, 188 aa, Homo sapiens
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFW

SEQ ID NO: 1909 - protein, 852 aa, Homo sapiens
MKPMLKDFSNLLLVVLCDYVLGEAEYLLLREPGHVALSNDTVYVDFQYFDGANGTLRNVSVLLLEANTNQTVTTKYLLTNQSQGTLKFECFYFKEAGDYWFTMTPEATDNSTPFPWWEKSAFLKVEWPVFHVDLNRSAKAAEGTFQVGLFTSQPLCPFPVDKPNIVVDVIFTNSLPEARRNSRQPLEIRTSKRTELAQGQWVEFGCAPLGPEAYVTVVLKLLGRDSVITSTGPIDLAQKFGYKLVMVPELTCESGVEVTVLPPPCTFVQGVVTVFKEAPRYPGKRTIHLAENSLPLGERRTIFNCTLFDMGKNKYCFDFGISSRSHFSAKEECMLIQRNTETWGLWQPWSQCSATCGDGVRERRRVCLTSFPSSPVCPGMSLEASLCSLEECAAFQPSSPSPLQPQGPVKSNNIVTVTGISLCLFIIIATVLITLWRRFGRPAKCSTPARHNSIHSPSFRKNSDEENICELSEQRGSFSDGGDGPTGSPGDTGIPLTYRRSGPVPPEDDASGSESFQSNAQKIIPPLFSYRLAQQQLKEMKKKGLTETTKVYHVSQSPLTDTAIDAAPSAPLDLESPEEAAANKFRIKSPFPEQPAVSAGERPPSRLDLNVTQASCAISPSQTLIRKSQARHVGSRGGPSERSHARNAHFRRTASFHEARQARPFRERSMSTLTPRQAPAYSSRTRTCEQAEDRFRPQSRGAHLFPEKLEHFQEASGTRGPLNPLPKSYTLGQPLRKPDLGDHQAGLVAGIERTEPHRARRGPSPSHKSVSRKQSSPISPKDNYQRVSSLSPSQCRKDKCQSFPTHPEFAFYDNTSFGLTEAEQRMLDLPGYFGSNEEDETTSTLSVEKLVI

SEQ ID NO: 1910 - protein, 122 aa, Homo sapiens
MGFHFCIWIIFLLPPPCKKCLSPPTMNLRPPKSCGNVFYWVLVLNSGLLYKFCQTIKCRANWRPARAPRGWNEATERHQERRTQMETEMGGISTTYWHRLCTCTDRRAEKLVMDGNNCWFHK

SEQ ID NO: 1911 - protein, 325 aa, Homo sapiens
MQGRVAGSCAPLGLLLVCLHLPGLFARSIGVVEEKVSQNLGTNLPQLGQPSSTGPSNSEHPQPALDPRSNDLARVPLKLSVPASDGFPPAGGSAVQRWPPSWGLPAMDSWPPEDPWQMMAAAAEDRLGEALPEELSYLSSAAALAPGSGPLPGESSPDATGLSPKASLLHQDSESRRLPRSNSLGAGGKILSQRPPWSLIHRVLPDHPWGTLNPSVSWGGGGPGTGWGTRPMPHPEGIWGINNQPPGTSWGNINRYPGGSWGNINRYPGGSWGNINRYPGGSWGNIHLYPGINNPFPPGVLRPPGSSWNIPAGFPNPPSPRLQWG

SEQ ID NO: 1912 - protein, 876 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 1913 - protein, 223 aa, Homo sapiens
MKFVPCLLLVTLSCLGTLGQAPRQKQGSTGEEFHFQTGGRDSCTMRPSSLGQGAGEVWLRVDCRNTDQTYWCEYRGQPSMCQAFAADPKPYWNQALQELRRLHHACQGAPVLRPSVCREAGPQAHMQQVTSSLKGSPEPNQQPEAGTPSLRPKATVKLTEATQLGKDSMEELGKAKPTTRPTAKPTQPGPRPGGNEEAKKKAWEHCWKPFQALCAFLISFFRG

SEQ ID NO: 1914 - protein, 194 aa, Homo sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWAGLRATLPPTQEALPSSHSSPQQQG

SEQ ID NO: 1915 - protein, 258 aa, Homo sapiens
MIAISAVSSALLFSLLCEASTVVLLNSTDSSPPTNNFTDIEAALKAQLDSADIPKARRKRYISQNDMIAILDYHNQVRGKVFPPAANMEYMVWDENLAKSAEAWAATCIWDHGPSYLLRFLGQNLSVRTGRYRSILQLVKPWYDEVKDYAFPYPQDCNPRCPMRCFGPMCTHYTQMVWATSNRIGCAIHTCQNMNVWGSVWRRAVYLVCNYAPKGNWIGEAPYKVGVPCSSCPPSYGGSCTDNLCFPGVTSNYLYWFK

SEQ ID NO: 1916 - protein, 301 aa, Homo sapiens
MLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPVILIVDKVLETQDLNGDGLMTPAELINFPGVALRHVEPGEPLAPSPQEPQAVGRQSLLAKSPLRQETQEAPGPREEAKGQVEARRESLDPVQEPGGQAEADGDVPGPRGEAEGQAEAKGDAPGPRGEAGGQAEAEGDAPGPRGEAGGQAEARENGEEAKELPGETLESKNTQNDFEVHIVQVENDEI

SEQ ID NO: 1917 - protein, 322 aa, Homo sapiens
MKTLAGLVLGLVIFDAAVTAPTLESINYDSETYDATLEDLDNLYNYENIPVDKVEIEIATVMPSGNRELLTPPPQPEKAQEEEEEEESTPRLIDGSSPQEPEFTGVLGPHTNEDFPTCLLCTCISTTVYCDDHELDAIPPLPKNTAYFYSRFNRIKKINKNDFASLSDLKRIDLTSNLISEIDEDAFRKLPQLRELVLRDNKIRQLPELPTTLTFIDISNNRLGRKGIKQEAFKDMYDLHHLYLTDNNLDHIPLPLPENLRALHLQNNNILEMHEDTFCNVKNLTYIRKALEDIRLDGNPINLSKTPQAYMCLPRLPVGSLV

SEQ ID NO: 1918 - protein, 205 aa, Homo sapiens
MVNLAAMVWRRLLRKRWVLALVFGLSLVYFLSSTFKQEERAVRDRNLLQVHDHNQPIPWKVQFNLGNSSRPSNQCRNSIQGKHLITDELGYVCERKDLLVNGCCNVNVPSTKQYCCDGCWPNGCCSAYEYCVSCCLQPNKQLLLERFLNRAAVAFQNLFMAVEDHFELCLAKCRTSSQSVQHENTYRDPIAKYCYGESPPELFPA

SEQ ID NO: 1919 - protein, 1018 aa, Homo sapiens
MVSHFMGSLSVLCFLLLLGFQFVCPQPSTQHRKVPQRMAAEGAPEDDGGGGAPGVWGAWGPWSACSRSCSGGVMEQTRPCLPRSYRLRGGQRPGAPARAFADHVVSAVRTSVPLHRSRDETPALAGTDASRQGPTVLRGSRHPQPQGLEVTGDRRSRTRGTIGPGKYGYGKAPYILPLQTDTAHTPQRLRRQKLSSRHSRSQGASSARHGYSSPAHQVPQHGPLYQSDSGPRSGLQAAEAPIYQLPLTHDQGYPAASSLFHSPETSNNHGVGTHGATQSFSQPARSTAISCIGAYRQYKLCNTNVCPESSRSIREVQCASYNNKPFMGRFYEWEPFAEVKGNRKCELNCQAMGYRFYVRQAEKVIDGTPCDQNGTAICVSGQCKSIGCDDYLGSDKVVDKCGVCGGDNTGCQVVSGVFKHALTSLGYHRVVEIPEGATKINITEMYKSNNYLALRSRSGRSIINGNWAIDRPGKYEGGGTMFTYKRPNEISSTAGESFLAEGPTNEILDVYMIHQQPNPGVHYEYVIMGTNAISPQVPPHRRPGEPFNGQMVTEGRSQEEGEQKGRNEEKEDLRGEAPEMFTSESAQTFPVRHPDRFSPHRPDNLVPPAPQPPRRSRDHNWKQLGTTECSTTCGKGSQYPIFRCVHRSTHEEAPESYCDSSMKPTPEEEPCNIFPCPAFWDIGEWSECSKTCGLGMQHRQVLCRQVYANRSLTVQPYRCQHLEKPETTSTCQLKICSEWQIRTDWTSCSVPCGVGQRTRDVKCVSNIGDVVDDEECNMKLRPNDIENCDMGPCAKSWFLTEWSERCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMCSKSCQGGFRVREVRCLSDDMTLSNLCDPQLKPEERESCNPQDCVPEVDENCKDKYYNCNVVVQARLCVYNYYKTACCASCTRVANRQTGFLGSR

SEQ ID NO: 1920 - protein, 500 aa, Homo sapiens
MKCTAREWLRVTTVLFMARAIPAMVVPNATLLEKLLEKYMDEDGEWWIAKQRGKRAITDNDMQSILDLHNKLRSQVYPTASNMEYMTWDVELERSAESWAESCLWEHGPASLLPSIGQNLGAHWGRYRPPTFHVQSWYDEVKDFSYPYEHECNPYCPFRCSGPVCTHYTQVVWATSNRIGCAINLCHNMNIWGQIWPKAVYLVCNYSPKGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 1921 - protein, 689 aa, Homo sapiens
MKFGAVTRIGGPPLGNQSPSSCSLLHEKDPPTTSGPQTDQPKKHLTNFKSATRRVARTQWLTADRQTWASISSVPWAQTISEKKPGGSLWETRSSPPTTAGTEEAMNTTSLLAPAAEIMATPGSPSQASPTLGAFTHGTQTPSPTKATAPRYPQTGDLSAEWPFTAGEEPVLVPRPHQVSRVRSSCCLSPILCSPAMIAFLLTSVLMIPHAGGHPLDTPHLPQELPPGLPNNINITFFSGMFKNVESVAEIFDCLGPHFTWLQAVFTNFPVLIQFVNGMKCVAGLCPRDFEDYGCTCRFEMEGLPVDESDSCCFQHRRCYEEAAEMDCLQDPAKLSTEVNCVSKKIICESKDNCEHLLCTCDKAAIECLARSSLNSSLNLLDTSFCLAQTPETTIKEDLTTLLPRVVPVEPTDTSLTALSGEVAAETEADRLITLSKKKAGHDQEGVGAARATSPPGSAEIVATRVTAKIVTLVPAGIKSLGLAVSSVENDPEETTEKACDRFTFLHLGSGDNMQVMPQLGEMLFCLTSRCPEEFESYGCYCGQEGRGEPRDDLDRCCLSHHCCLEQVRRLGCLLERLPWSPVVCVDHTPKCGGQSLCEKLLCACDQTAAECMTSASFNQSLKSPSRLGCPGQPAACEDSLHPVPAAPTLGSSSEEDSEEDPPQEDLGRAKRFLRKSLGPLGIGPLHGR

SEQ ID NO: 1922 - protein, 452 aa, Homo sapiens
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLVCLCQRHVRHLQRDALSQLMNGPIRKKLKIIPEDQSWGGQATNVFVNMEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 1923 - protein, 464 aa, Homo sapiens
MVRLAAELLLLLGLLLLTLHITVLRGSGAADGPDAAAGNASQAQLQNNLNVGSDTTSETSFSLSKEAPREHLDHQAAHQPFPRPRFRQETGHPSLQRDFPRSFLLDLPNFPDLSKADINGQNPNIQVTIEVVDGPDSEADKDQHPENKPSWSVPSPDWRAWWQRSLSLARANSGDQDYKYDSTSDDSNFLNPPRGWDHTAPGHRTFETKDQPEYDSTDGEGDWSLWSVCSVTCGNGNQKRTRSCGYACTATESRTCDRPNCPGIEDTFRTAATEVSLLAGSEEFNATKLFEVDTDSCERWMSCKSEFLKKYMHKVMNDLPSCPCSYPTEVAYSTADIFDRIKRKDFRWKDASGPKEKLEIYKPTARYCIRSMLSLESTTLAAQHCCYGDNMQLITRGKGAGTPNLISTEFSAELHYKVDVLPWIICKGDWSRYNEARPPNNGQKCTESPSDEDYIKQFQEAREY

SEQ ID NO: 1924 - protein, 511 aa, Homo sapiens
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 1925 - protein, 258 aa, Homo sapiens
MKQILHPALETTAMTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYVCQYCPAGNWANRLYVPYEQGAPCASCPDNCDDGLCTNGCKYEDLYSNCKSLKLTLTCKHQLVRDSCKASCNCSNSIY

SEQ ID NO: 1926 - protein, 237 aa, Homo sapiens
MVTPPPPPVFSLLKISQRIVCLVLDKSGSMGGKDRLNRMNQAAKHFLLQTVENGSWVGMVHFDSTATIVNKLIQIKSSDERNTLMAGLPTYPLGGTSICSGIKYAFQVIGELHSQLDGSEVLLLTDGEDNTASSCIDEVKQSGAIVHFIALGRAADEAVIEMSKITGGSHFYVSDEAQNNGLIDAFGALTSGNTDLSQKSLQVRVLIPWVFMFTFATRKNHLVVISFEFHIFLKVNF

SEQ ID NO: 1927 - protein, 152 aa, Homo sapiens
MDNVQPKIKHRPFCFSVKGHVKMLRLALTVTSMTFFIIAQAPEPYIVITGFEVTVILFFILLYVLRLDRLMKWLFWPLLDIINSLVTTVFMLIVSVLALIPETTTLTVGGGVFALVTAVCCLADGALIYRKLLFNPSGPYQKKPVHEKKEVL

SEQ ID NO: 1928 - protein, 1247 aa, Homo sapiens
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYDIDECSEQPSVCGSHTICNNHPGTFRCECVEGYQFSDEGTCVAVVDQRPINYCETGLHNCDIPQRAQCIYTGGSSYTCSCLPGFSGDGQACQDVDECQPSRCHPDAFCYNTPGSFTCQCKPGYQGDGFRCVPGEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIEQK

SEQ ID NO: 1929 - protein, 174 aa, Homo sapiens
MLRTESCRPRSPAGQVAAASPLLLLLLLLAWCAGACRGAPILPQGLQPEQQLQLWNEIDDTCSSFLSIDSQPQASNALEELCFMIMGMLPKPQEQDEKDNTKRFLFHYSKTQKLGKSNVVSSVVHPLLQLVPHLHERRMKRFRVDEEFQSPFASQSRGYFLFRPRNGRRSAGFI

SEQ ID NO: 1930 - protein, 405 aa, Homo sapiens
MDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKKNGSTVKIPMMKALLRTKYGYFSESSLNYQVLELSYKGDEFSLIIILPAEGMDIEEVEKLITAQQILKWLSEMQEEEVEISLPRFKVEQKVDFKDVLYSLNITEIFSGGCDLSGITDSSEVYVSQVTQKVFFEINEDGSEAATSTGIHIPVIMSLAQSQFIANHPFLFIMKHNPTESILFMGRVTNPDTQEIKGRDLDSL

SEQ ID NO: 1931 - protein, 1228 aa, Homo sapiens
MKGARLFVLLSSLWSGGIGLNNSKHSWTIPEDGNSQKTMPSASVPPNKIQSLQILPTTRVMSAEIATTPEARTSEDSLLKSTLPPSETSAPAEGVRNQTLTSTEKAEGVVKLQNLTLPTNASIKFNPGAESVVLSNSTLKFLQSFARKSNEQATSLNTVGGTGGIGGVGGTGGVGNRAPRETYLSRGDSSSSQRTDYQKSNFETTRGKNWCAYVHTRLSPTVILDNQVTYVPGGKGPCGWTGGSCPQRSQKISNPVYRMQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKGLKSKSINVLIRDIVREQFKIFQNDMQETVAQLFKTVSSLSEDLESTRQIIQKVNESVVSIAAQQKFVLVQENRPTLTDIVELRNHIVNVRQEMTLTCEKPIKELEVKQTHLEGALEQEHSRSILYYESLNKTLSKLKEVHEQLLSTEQVSDQKNAPAAESVSNNVTEYMSTLHENIKKQSLMMLQMFEDLHIQESKINNLTVSLEMEKESLRGECEDMLSKCRNDFKFQLKDTEENLHVLNQTLAEVLFPMDNKMDKMSEQLNDLTYDMEILQPLLEQGASLRQTMTYEQPKEAIVIRKKIENLTSAVNSLNFIIKELTKRHNLLRNEVQGRDDALERRINEYALEMEDGLNKTMTIINNAIDFIQDNYALKETLSTIKDNSEIHHKCTSDMETILTFIPQFHRLNDSIQTLVNDNQRYNFVLQVAKTLAGIPRDEKLNQSNFQKMYQMFNETTSQVRKYQQNMSHLEEKLLLTTKISKNFETRLQDIESKVTQTLIPYYISVKKGSVVTNERDQALQLQVLNSRFKALEAKSIHLSINFFSLNKTLHEVLTMCHNASTSVSELNATIPKWIKHSLPDIQLLQKGLTEFVEPIIQIKTQAALSNLTCCIDRSLPGSLANVVKSQKQVKSLPKKINALKKPTVNLTTVLIGRTQRNTDNIIYPEEYSSCSRHPCQNGGTCINGRTSFTCACRHPFTGDNCTIKLVEENALAPDFSKGSYRYAPMVAFFASHTYGMTIPGPILFNNLDVNYGASYTPRTGKFRIPYLGVYVFKYTIESFSAHISGFLVVDGIDKLAFESENINSEIHCDRVLTGDALLELNYGQEVWLRLAKGTIPAKFPPVTTFSGYLLYRT

SEQ ID NO: 1932 - protein, 454 aa, Homo sapiens
MWPLTVPPPLLLLLCSGLAGQTLFQNPEEGWQLYTSAQAPDGKCICTAVIPAQSTCSRDGRSRELRQLMEKVQNVSQSMEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 1933 - protein, 302 aa, Homo sapiens
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGEAGHHLPEPSSRETGRGAKGERGSKSHPNAHARGRVGGLGAQGPSGSSEWEDEQSEYSDIRR

SEQ ID NO: 1934 - protein, 842 aa, Homo sapiens
MKPGGFWLHLTLLGASLPAALGWMDPGTSRGPDVGVGESQAEEPRSFEVTRREGLSSHNELLASCGKKFCSRGSRCVLSRKTGEPECQCLEACRPSYVPVCGSDGRFYENHCKLHRAACLLGKRITVIHSKDCFLKGDTCTMAGYARLKNVLLALQTRLQPLQEGDSRQDPASQKRLLVESLFRDLDADGNGHLSSSELAQHVLKKQDLDEDLLGCSPGDLLRFDDYNSDSSLTLREFYMAFQVVQLSLAPEDRVSVTTVTVGLSTVLTCAVHGDLRPPIIWKRNGLTLNFLDLEDINDFGEDDSLYITKVTTIHMGNYTCHASGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICPQREKNATQPCQWVSAVNVRNRYIYVAQPALSRVLVVDIQAQKVLQSIGVDPLPAKLSYDKSHDQVWVLSWGDVHKSRPSLQVITEASTGQSQHLIRTPFAGVDDFFIPPTNLIINHIRFGFIFNKSDPAVHKVDLETMMPLKTIGLHHHGCVPQAMAHTHLGGYFFIQCRQDSPASAARQLLVDSVTDSVLGPNGDVTGTPHTSPDGRFIVSAAADSPWLHVQEITVRGEIQTLYDLQINSGISDLAFQRSFTESNQYNIYAALHTEPDLLFLELSTGKVGMLKNLKEPPAGPAQPWGGTHRIMRDSGLFGQYLLTPARESLFLINGRQNTLRCEVSGIKGGTTVVWVGEV

SEQ ID NO: 1935 - protein, 751 aa, Homo sapiens
MAFRTICVLVGVFICSICVKGSSQPQARVYLTFDELRETKTSEYFSLSHHPLDYRILLMDEDQDRIYVGSKDHILSLNINNISQEALSVFWPASTIKVEECKMAGKDPTHGCGNFVRVIQTFNRTHLYVCGSGAFSPVCTYLNRGRRSEDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDELEDVFLLETDNPRTTLVYGIFTTSSSVFKGSAVCVYHLSDIQTVFNGPFAHKEGPNHQLISYQGRIPYPRPGTCPGGAFTPNMRTTKEFPDDVVTFIRNHPLMYNSIYPIHKRPLIVRIGTDYKYTKIAVDRVNAADGRYHVLFLGTDRGTVQKVVVLPTNNSVSGELILEELEVFKNHAPITTMKISSKKQQLYVSSNEGVSQVSLHRCHIYGTACADCCLARDPYCAWDGHSCSRFYPTGKRRSRRQDVRHGNPLTQCRGFNLKAYRNAAEIVQYGVKNNTTFLECAPKSPQASIKWLLQKDKDRRKEVKLNERIIATSQGLLIRSVQGSDQGLYHCIATENSFKQTIAKINFKVLDSEMVAVVTDKWSPWTWASSVRALPFHPKDIMGAFSHSEMQMINQYCKDTRQQHQQGDESQKMRGDYGKLKALINSRKSRNRRNQLPES

SEQ ID NO: 1936 - protein, 771 aa, Homo sapiens [sequence omitted]

SEQ ID NO: 1937 - protein, 1534 aa, Homo sapiens
MALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQLVDLSNNKISSLSNSSFTNMSQLTTLILSYNALQCIPPLAFQGLRSLRLLSLHGNDISTLQEGIFADVTSLSHLAIGANPLYCDCHLRWLSSWVKTGYKEPGIARCAGPQDMEGKLLLTTPAKKFECQGPPTLAVQAKCDLCLSSPCQNQGTCHNDPLEVYRCACPSGYKGRDCEVSLDSCSSGPCENGGTCHAQEGEDAPFTCSCPTGFEGPTCGVNTDDCVDHACANGGVCVDGVGNYTCQCPLQYEGKACEQLVDLCSPDLNPCQHEAQCVGTPDGPRCECMPGYAGDNCSENQDDCRDHRCQNGAQCMDEVNSYSCLCAEGYSGQLCEIPPHLPAPKSPCEGTECQNGANCVDQGNRPVCQCLPGFGGPECEKLLSVNFVDRDTYLQFTDLQNWPRANITLQVSTAEDNGILLYNGDNDHIAVELYQGHVRVSYDPGSYPSSAIYSAETINDGQFHTVELVAFDQMVNLSIDGGSPMTMDNFGKHYTLNSEAPLYVGGMPVDVNSAAFRLWQILNGTGFHGCIRNLYINNELQDFTKTQMKPGVVPGCEPCRKLYCLHGICQPNATPGPMCHCEAGWVGLHCDQPADGPCHGHKCVHGQCVPLDALSYSCQCQDGYSGALCNQAGALAEPCRGLQCLHGHCQASGTKGAHCVCDPGFSGELCEQESECRGDPVRDFHQVQRGYAICQTTRPLSWVECRGSCPGQGCCQGLRLKRRKFTFECSDGTSFAEEVEKPTKCGCALCA

SEQ ID NO: 1938 - protein, 113 aa, Homo sapiens
MDSRQAAALLVLLLLIDGGCAEGPGGQQEDQLSAEEDSEPLPPQDAQTSGSLLHYLLQAMERPGRSQAFLFQPQRFGRNTQGSWRNEWLSPRAGEGLNSQFWSLAAPQRFGKK

SEQ ID NO: 1939 - protein, 855 aa, Homo sapiens
MARHLLLPLVMLVISPIPGAFQDSALSPTQEEPEDLDCGRPEPSARIVGGSNAQPGTWPWQVSLHHGGGHICGGSLIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDPQEPREENCTIALPECGKAPRPGAWPWEAQVMVPGSRPCHGALVSESWVLAPASCFLDPNSSDSPPRDLDAWRVLLPSRPRAERVARLVQHENASWDNASDLALLQLRTPVNLSAASRPVCLPHPEHYFLPGSRCRLARWGRGEPALGPGALLEAELLGGWWCHCLYGRQGAAVPLPGDPPHALCPAYQEKEEVGSCWNDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQVSRLVISIRLPQHLGLRPPLALLELSSRVEPSPSALPICLHPAGIPPGASCWVLGWKEPQDRVPVAAAVSILTQRICDCLYQGILPPGTLCVLYAEGQENRCEMTSAPPLLCQMTEGSWILVGMAVQGSRELFAAIGPEEAWISQTVGEANFLPPSGSPHWPTGGSNLCPPELAKASGSPHAVYFLLLLTLLIQS

SEQ ID NO: 1940 - protein, 303 aa, Homo sapiens [sequence omitted]

SEQ ID NO: 1941 - protein, 385 aa, Homo sapiens
MKMLPGVGVFGTGSSARVLVPLLRAEGFTVEALWGKTEEEAKQLAEEMNIAFYTSRTDDILLHQDVDLVCISIPPPLTRQISVKALGIGKNVVCEKAATSVDAFRMVTASRYYPQLMSLVGNVLRFLPAFVRMKQLISEHYVGAVMICDARIYSGSLLSPSYGWICDELMGGGGLHTMGTYIVDLLTHLTGRRAEKVHGLLKTFVRQNAAIRGIRHVTSDDFCFFQMLMGGGVCSTVTLNFNMPGAFVHEVMVVGSAGRLVARGADLYGQKNSATQEELLLRDSLAVGAGLPEQGPQDVPLLYLKGMVYMVQALRQSFQGQGDRRTWDRTPVSMAASFEDGLYMQSVVDAIKRSSRSGEWEAVEVLTEEPDTNQNLCEALQRNNL

SEQ ID NO: 1942 - protein, 489 aa, Homo sapiens
MPVTFALLLLLGQATADPCYDPQGRPQFCLPPVTQLAAVAASCPQACALSPGNHLGARETCNGSLTLALGGPFLLTSVSLRFCTPGPPALILSAAWASGGPWRLLWHRPAWPGALGGPERVTFHSTPGPKATVAASHLRVEFGGQAGLAAAGLRGRCQCHGHAARCAARARPPRCHCRHHTTGPGCESCRPSHRDWPWRPATPRHPHPCLPCSCNQHARRCRFNSELFRLSGGRSGGVCERCRHHTAGRHCHYCQPGFWRDPSQPIFSRRACRACQCHPIGATGGTCNQTSGQCTCKLGVTGLTCNRCGPGYQQSRSPRMPCQRIPEATTTLATTPGAYSSDPQCQNYCNMSDTRVHMSLRRYCQQDHVLRAQVLASEAAGPAWQRLAVRVLAVYKQRAQPVRRGDQDAWVPRADLTCGCLRLQPGTDYLLLGSAVGDPDPTRLILDRHGLALPWRPRWARPLKRLQQEERAGGCRGVRAPTPSPRPEH

SEQ ID NO: 1943 - protein, 2809 aa, Homo sapiens
MTLEGLYLARGPLARLLLAWSALLCMAGGQGRWDGALEAAGPGRVRRRGSPGILQGPNVCGSRFHAYCCPGWRTFPGRSQCVVPICRRACGEGFCSQPNLCTCADGTLAPSCGVSRGSGCSVSCMNGGTCRGASCLCQKGYTGTVCGQPICDRGCHNGGRCIGPNRCACVYGFMGPQCERDYRTGPCFGQVGPEGCQHQLTGLVCTKALCCATVGRAWGLPCELCPAQPHPCRRGFIPNIHTGACQDVDECQAVPGLCQGGSCVNMVGSFHCRCPVGHRLSDSSAACEDYRAGACFSVLFGGRCAGDLAGHYTRRQCCCDRGRCWAAGPVPELCPPRGSNEFQQLCAQRLPLLPGHPGLFPGLLGFGSNGMGPPLGPARLNPHGSDARGIPSLGPGNSNIGTATLNQTIDICRHFTNLCLNGRCLPTPSSYRCECNVGYTQDVRGECIDVDECTSSPCHHGDCVNIPGTYHCRCYPGFQATPTRQACVDVDECIVSGGLCHLGRCVNTEGSFQCVCNAGFELSPDGKNCVDHNECATSTMCVNGVCLNEDGSFSCLCKPGFLLAPGGHYCMDIDECQTPGICVNGHCTNTEGSFRCQCLGGLAVGTDGRVCVDTHVRSTCYGAIEKGSCARPFPGTVTKSECCCANPDHGFGEPCQLCPAKDSAEFQALCSSGLGITTDGRDINECALDPEVCANGVCENLRGSYRCVCNLGYEAGASGKDCTDVDECALNSLLCDNGWCQNSPGSYSCSCPPGFHFWQDTEICKDVDECLSSPCVSGVCRNLAGSYTCKCGPGSRLDPSGTFCLDSTKGTCWLKIQESRCEVNLQGASLRSECCATLGAAWGSPCERCEIDPACARGFARMTGVTCDDVNECESFPGVCPNGRCVNTAGSFRCECPEGLMLDASGRLCVDVRLEPCFLRWDEDECGVTLPGKYRMDVCCCSIGAVWGVECEACPDPESLEFASLCPRGLGFASRDFLSGRPFYKDVNECKVFPGLCTHGTCRNTVGSFHCACAGGFALDAQERNCTDIDECRISPDLCGQGTCVNTPGSFECECFPGYESGFMLMKNCMDVDECARDPLLCRGGTCTNTDGSYKCQCPPGHELTAKGTACEDIDECSLSDGLCPHGQCVNVIGAFQCSCHAGFQSTPDRQGCVDINECRVQNGGCDVHCINTEGSYRCSCGQGYSLMPDGRACADVDECEENPRVCDQGHCTNMPGGHRCLCYDGFMATPDMRTCVDVDECDLNPHICLHGDCENTKGSFVCHCQLGYMVRKGATGCSDVDECEVGGHNCDSHASCLNIPGSFSCRCLPGWVGDGFECHDLDECVSQEHRCSPRGDCLNVPGSYRCTCRQGFAGDGFFCEDRDECAENVDLCDNGQCLNAPGGYRCECEMGFDPTEDHRACQDVDECAQGNLCAFGSCENLPGMFRCICNGGYELDRGGGNCTDINECADPVNCINGVCINTPGSYLCSCPQDFELNPSGVGCVDTRAGNCFLETHDRGDSGISCSAEIGVGVTRASCCCSLGRAWGNPCELCPMANTTEYRTLCPGGEGFQPNRITVILEDIDECQELPGLCQGGDCVNTFGSFQCECPPGYHLSEHTRICEDIDECSTHSGICGPGTCYNTLGNYTCVCPAEYLQVNGGNNCMDMRKSVCFRHYNGTCQNELAFNVTRKMCCCSYNIGQAWNRPCEACPTPISPDYQILCGNQAPGFLTDIHTGKPLDIDECGEIPAICANGICINQIGSFRCECPAGFNYNSILLACEDVDECGSRESPCQQNADCINIPGSYRCKCTRGYKLSPGGACVGRNECREIPNVCSHGDCMDTEGSYMCLCHRGFQASADQTLCMDIDECDRQPCGNGTCKNIIGSYNCLCFPGFVVTHNGDCVDFDECTTLVGQVCRFGHCLNTAGSFHCLCQDGFELTADGKNCVDTNECLSLAGTCLPGTCQNLEGSFRCICPPGFQVQSDHCIDIDECSEEPNLCLFGTCTNSPGSFQCLCPPGFVLSDNGHRCFDTRQSFCFTRFEAGKCSVPKAFNTTKTRCCCSKRPGEGWGDPCELCPQEGSAAFQELCPFGHGAVPGPDDSREDVNECAENPGVCTNGVCVNTDGSFRCECPFGYSLDFTGINCVDTDECSVGHPCGQGTCTNVIGGFECACADGFEPGLMMTCEDIDECSLNPLLCAFRCHNTEGSYLCTCPAGYTLREDGAMCRDVDECADGQQDCHARGMECKNLIGTFACVCPPGMRPLPGSGEGCTDDNECHAQPDLCVNGRCVNTAGSFRCDCDEGFQPSPTLTECHDIRQGPCFAEVLQTMCRSLSSSSEAVTRAECCCGGGRGWGPRCELCPLPGTSAYRKLCPHGSGYTAEGRDVDECRMLAHLCAHGECINSLGSFRCHCQAGYTPDATATTCLDMDECSQVPKPCTFLCKNTKGSFLCSCPRGYLLEEDGRTCKDLDECTSRQHNCQFLCVNTVGAFTCRCPPGFTQHHQACFDNDECSAQPGPCGAHGHCHNTPGSFRCECHQGFTLVSSGHGCEDVNECDGPHRCQHGCQNQLGGYRCSCPQGFTQHSQWAQCVDENECALSPPTCGSASCRNTLGGFRCVCPSGFDFDQALGGCQEVDECAGRRGPCSYSCANTPGGFLCGCPQGYFRAGQGHCVSGLGFSPGPQDTPDKEELLSSEACYECKINGLSPRDRPRRSAHRDHQVNLATLDSEALLTLGLNLSHLGRAERILELRPALEGLEGRIRYVIVRGNEQGFFRMHHLRGVSSLQLGRRRPGPGTYRLEVVSHMAGPWGVQPEGQPGPWGQALRLKVQLQLL

SEQ ID NO: 1944 - protein, 100 aa, Homo sapiens
METRQVSRSPRVRLLLLLLLLLVVPWGVRTASGVALPPVGVLSLRPPGRAWADPATPRPRRSLALADDAAFRERARLLAALERRHWLNSYMHKLLVLDAP

SEQ ID NO: 1945 - protein, 467 aa, Homo sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 1946 - protein, 734 aa, Homo sapiens
MFYVCSSCVFLCGSNFPNFPFQVASAKSAPEIPTIDQAYSKLSNSITVEWATVPGATSYLLTAEDGDTVIETTVANSPGTVTGLKAATWYEITIRSISAAGRSQASPPKQAKTVLAAPILEVSSPSSDSILVQWEAVYMAIAFSVSIMRANGLGSIWKENTTNTSLTFTSLEAGTLYTIKAYAWNANRIPGDDSTCNQRTSPRAPANIQVSFDSGALKASFSWARAEGAFNYTVMALSDSSELTCSTTFSSCTISSLQCGTEYLISVLASNDAGSSKSSSAMTLKTVACAPGRVTIQEDPPGHLSVAWSSVDLGDYYVVFVKSDDGLEVHCNTSLTQCNFLSECGFTYFISVFVYNKAGQSPLGDIFNYTTAPCCPSDINPVLVSSDRVEIVWSPVRGAELYETKAVDGYNMVECNDTTPACTLSALECDTKYNITVYSFNEVRGSNMSCTPQFITTAPCSPEIKNVSRDAFSMINVHWRSTNDDATYTVTAQGEKGLYQCSSTGESCTMRGLPCGSVFSVTAVAETQAGRSLPSYSVPLETVPCCPTGLTVTQITQSVINVSWTIGRVAQTHVAVLESHTGQSKCHTHQNHCLLGCITCGINYTVTLKAISATGLTADCSYQSYFSGACCPLGVKLYRLGPNGIRIYWQASRGSANYSTDLYGSKGIFTCTPSAGLSFCDVTEIPCGDVYTVMVSPVAKTGLKLTFCPKKIYSVTCSGSTLGMVIYRGKRNEE

SEQ ID NO: 1947 - protein, 365 aa, Homo sapiens
MLDGSPLARWLAAAFGLTLLLAALRPSAAYFGLTGSEPLTILPLTLEPEAAAQAHYKACDRLKLERKQRRMCRRDPGVAETLVEAVSMSALECQFQFRFERWNCTLEGRYRASLLKRGFKETAFLYAISSAGLTHALAKACSAGRMERCTCDEAPDLENREAWQWGGCGDNLKYSSKFVKEFLGRRSSKDLRARVDFHNNLVGVKVIKAGVETTCKCHGVSGSCTVRTCWRQLAPFHEVGKHLKHKYETALKVGSTTNEAAGEAGAISPPRGRASGAGGSDPLPRTPELVHLDDSPSFCLAGRFSPGTAGRRCHREKNCESICCGRGHNTQSRVVTRPCQCQVRWCCYVECRQCTQREEVYTCKG

SEQ ID NO: 1948 - protein, 264 aa, Homo sapiens
MRLRPLPLVVVPGLLQLLFCDSKEVVHATEGLDWEDKDAPGTLVGNVVHSRIISPLRLFVKQSPVPKPGPMAYADSMENFWDWLANITEIQEPLARTKRRPIVKTGKFKKMFGWGDFHSNIKTVKLNLLITGKIVDHGNGTFSVYFRHNSTGLGNVSVSLVPPSKVVEFEVSPQSTLETKESKSFNCRIEYEKTDRAKKTALCNFDPSKICYQEQTQSHVSWLCSKPFKVICIYIAFYSVDYKLVQKVCPDYNYHSETPYLSSG

SEQ ID NO: 1949 - protein, 374 aa, Homo sapiens
MKPLLETLYLLGMLVPGGLGYDRSLAQHRQEIVDKSVSPWSLETYSYNIYHPMGEIYEWMREISEKYKEVVTQHFLGVTYETHPMYYLKISQPSGNPKKIIWMDCGIHAREWIAPAFCQWFVKEILQNHKDNSSIRKLLRNLDFYVLPVLNIDGYIYTWTTDRLWRKSRSPHNNGTCFGTDLNRNFNASWCSIGASRNCQDQTFCGTGPVSEPETKAVASFIESKKDDILCFLTMHSYGQLILTPYGYTKNKSSNHPEMIQVGQKAANALKAKYGTNYRVGSSADILYASSGSSRDWARDIGIPFSYTFELRDSGTYGFVLPEAQIQPTCEETMEAVLSVLDDVYAKHWHSDSAGRVTSATMLLGLLVSCMSLL

SEQ ID NO: 1950 - protein, 575 aa, Homo sapiens
MASWLRRKLRGKRRPVIAFCLLMILSAMAVTRFPPQRPSAGPDPGPMEPQGVTGAPATHIRQALSSSRRQRARNMGFWRSRALPRNSILVCAEEQGHRARVDRSRESPGGDLRHPGRVRRDITLSGHPRLSTQHVVLLREDEVGDPGTKDLGHPQHGSPIQETQSEVVTLVSPLPGSDMAALPAWRATSGLTLWPHTAEGRDLLGAENRALTGGQQAEDPTLASGAHQWPGSVEKLQGSVWCDAETLLSSSRTGGQAPPWLTDHDVQMLRLLAQGEVVDKARVPAHGQVLQVGFSTEAALQDLSSPRLSQLCSQGLCGLIKRPGDLPEVLSFHVDRVLGLRRSLPAVARRFHSPLLPYRYTDGGARPVIWWAPDVQHLSDPDEDQNSLALGWLQYQALLAHSCNWPGQAPCPGIHHTEWARLALFDFLLQVHDRLDRYCCGFEPEPSDPCVEERLREKCQNPAELRLVHILVRSSDPSHLVYIDNAGNLQHPEDKLNFRLLEGIDGFPESAVKVLASGCLQNMLLKSLQMDPVFWESQGGAQGLKQVLQTLEQRGQVLLGHIQKHNLTLFRDEDP

SEQ ID NO: 1951 - protein, 559 aa, Homo sapiens
MWTNFFKLRLFCCLLAVLMVVVLVINVTQVEYLDHETVSATFIDSSGQFVSSQVTGISRNPYCGYDQQTLSSQERMEEDSLLAALHRQVPDVGPVPFVKSTDPSSSYFVILNSAAFFKVGSQLEVLVHVQDFQRKPKKYGGDYLQARIHSLKLQAGAVGRVVDYQNGFYKVFFTLLWPGKVKVSVSLVHPSEGIRVLQRLQEDKPDRVYFKSLFRSGRISETTECNVCLPGNLPLCNFTDLYTGEPWFCFKPKKLPCSSRITHFKGGYLKGLLTAAESAFFQSGVNIKMPVNSSGPDWVTVIPRRIKETNSLELSQGSGTFPSGYYYKDQWRPRKFKMRQFNDPDNITECLQRKVVHLFGDSTIRQWFEYLTTFVPDLVEFNLGSPKNVGPFLAVDQKHNILLKYRCHGPPIRFTTVFSNELHYVANELNGIVGGKNTVVAIAVWSHFSTFPLEVYIRRLRNIRRAVVRLLDRSPKTVVVIRTANAQELGPEVSLFNSDWYNFQLDTILRRMFSGVGVYLVDAWEMTLAHYLPHKLHPDEVIVKNQLDMFLSFVCPLET

SEQ ID NO: 1952 - protein, 1207 aa, Homo sapiens
MRLTHICCCCLLYQLGFLSNGIVSELQFAPDREEWEVVFPALWRREPVDPAGGSGGSADPGWVRGVGGGGSARAQAAGSSREVRSVAPVPLEEPVEGRSESRLRPPPPSEGEEDEELESQELPRGSSGAAALSPGAPASWQPPPPPQPPPSPPPAQHAEPDGDEVLLRIPAFSRDLYLLLRRDGRFLAPRFAVEQRPNPGPGPTGAASAPQPPAPPDAGCFYTGAVLRHPGSLASFSTCGGGLMGFIQLNEDFIFIEPLNDTMAITGHPHRVYRQKRSMEEKVTEKSALHSHYCGIISDKGRPRSRKIAESGRGKRYSYKLPQEYNIETVVVADPAMVSYHGADAARRFILTILNMVFNLFQHKSLSVQVNLRVIKLILLHETPPELYIGHHGEKMLESFCKWQHEEFGKKNDIHLEMSTNWGEDMTSVDAAILITRKDFCVHKDEPCDTVGIAYLSGMCSEKRKCIIAEDNGLNLAFTIAHEMGHNMGINHDNDHPSCADGLHIMSGEWIKGQNLGDVSWSRCSKEDLERFLRSKASNCLLQTNPQSVNSVMVPSKLPGMTYTADEQCQILFGPLASFCQEMQHVICTGLWCKVEGEKECRTKLDPPMDGTDCDLGKWCKAGECTSRTSAPEHLAGEWSLWSPCSRTCSAGISSRERKCPGLDSEARDCNGPRKQYRICENPPCPAGLPGFRDWQCQAYSVRTSSPKHILQWQAVLDEEKPCALFCSPVGKEQPILLSEKVMDGTSCGYQGLDICANGRCQKVGCDGLLGSLAREDHCGVCNGNGKSCKIIKGDFNHTRGAGYVEVLVIPAGARRIKVVEEKPAHSYLALRDAGKQSINSDWKIEHSGAFNLAGTTVHYVRRGLWEKISAKGPTTAPLHLLVLLFQDQNYGLHYEYTIPSDPLPENQSSKAPEPLFMWTHTSWEDCDATCGGGERKTTVSCTKIMSKNISIVDNEKCKYLTKPEPQIRKCNEQPCQTRWMMTEWTPCSRTCGKGMQSRQVACTQQLSNGTLIRARERDCIGPKPASAQRCEGQDCMTVWEAGVWSECSVKCGKGIRHRTVRCTNPRKKCVLSTRPREAEDCEDYSKCYVWRMGDWSKCSITCGKGMQSRVIQCMHKITGRHGNECFSSEKPAAYRPCHLQPCNEKINVNTITSPRLAALTFKCLGDQWPVYCRVIREKNLCQDMRWYQRCCETCRDFYAQKLQQKS

SEQ ID NO: 1953 - protein, 85 aa, Homo sapiens
MKITGGLLLLCTVVYFCSSSEAASLSPKKVDCSIYKKYPVVAIPCPITYLPVCGSDYITYGNECHLCTESLKSNGRVQFLHDGSC

SEQ ID NO: 1954 - protein, 993 aa, Homo sapiens
MGSGRVPGLCLLVLLVHARAAQYSKAAQDVDECVEGTDNCHIDAICQNTPRSYKCICKSGYTGDGKHCKDVDECEREDNAGCVHDCVNIPGNYRCTCYDGFHLAHDGHNCLDVDECAEGNGGCQQSCVNMMGSYECHCREGFFLSDNQHTCIQRPEEGMNCMNKNHGCAHICRETPKGGIACECRPGFELTKNQRDCKLTCNYGNGGCQHTCDDTEQGPRCGCHIKFVLHTDGKTCIETCAVNNGGCDSKCHDAATGVHCTCPVGFMLQPDRKTCKDIDECRLNNGGCDHICRNTVGSFECSCKKGYKLLINERNCQDIDECSFDRTCDHICVNTPGSFQCLCHRGYLLYGITHCGDVDECSINRGGCRFGCINTPGSYQCTCPAGQGRLHWNGKDCTEPLKCQGSPGASKAMLSCNRSGKKDTCALTCPSRARFLPESENGFTVSCGTPSPRAAPARAGHNGNSTNSNHCHEAAVLSIKQRASFKIKDAKCRLHLRNKGKTEEAGRITGPGGAPCSECQVTFIHLKCDSSRKGKGRRARTPPGKEVTRLTLELEAEVRAEETTASCGLPCLRQRMERRLKGSLKMLRKSINQDRFLLRLAGLDYELAHKPGLVAGERAEPMESCRPGQHRAGTKCVSCPQGTYYHGQTEQCVPCPAGTFQEREGQLSCDLCPGSDAHGPLGATNVTTCAGQCPPGQHSVDGFKPCQPCPRGTYQPEAGRTLCFPCGGGLTTKHEGAISFQDCDTKVQCSPGHYYNTSIHRCIRCAMGSYQPDFRQNFCSRCPGNTSTDFDGSTSVAQCKNRQCGGELGEFTGYIESPNYPGNYPAGVECIWNINPPPKRKILIVVPEIFLPSEDECGDVLVMRKNSSPSSITTYETCQTYERPIAFTARSRKLWINFKTSEANSARGFQIPYVTYDEDYEQLVEDIVRDGRLYASENHQEILKDKKLIKAFFEVLAHPQNYFKYTEKHKEMLPKSFIKLLRSKVSSFLRPYK

SEQ ID NO: 1955 - protein, 1590 aa, Homo sapiens
MPGGACVLVIALMFLAWGEAQECSPGGHQFLRSPYRSVRFDSWHLQQSAVQDLICDHSLSPGWYRFLILDRPAEMPTKCVEMNHCGTQAPIWLSLRDSETLPSPGEIKQLTACATWQFLFSTTKDCCLFQIPVSVRNCGNFSVYLLQPTQGCMGYCAEAISDARLHPCGSDETETGGDCVRQLAASLPPPPAGRPEVLVELIESRLFCRCSFDVPATKNSVGFHIAWSRLSSQEVKEELTQETTVQAFSLLELDGINLRLGDRIFCSASVFFLENPHVQSVAIESQEFFAGFKLQPELSTISEDGKEYYLRIESTVPIICSEFSELDQECKISLKLKTIGQGREHLGLNLALSSCHVDLLQTSSCANGTCSHTFVYYTAVTDFSRDGDRVSNIVVQPIVNEDFLWNNYIPDSIQIKVKDVPTAYCYTFTDPHIITFDGRVYDNFKTGTFVLYKSMSRDFEVHVRQWDCRSLHYPVSCNCGFVAQEGGDIVTFDMCNGQLRESQPYLFIKSQDVTRNIKISESYLGRKVTIWFSSGAFIRADLGEWGMSLTIRAPSVDYRNTLGLCGTFDENPENDFHDKNGMQIDQNFNNYVAFINEWRILPGKSMSDTLPVSMTSPGKPSYCSCSLDTAAYPSSEDLDSVSRSEIALGCKDLNHVSLSSLIPELDVTSEYINSDTLVREINKHTSPEEYNLNLFLQEKKHINLTKLGLNVQKHPGNEKEDSLQYLANKKYTQGRGSHSQEMRYNRQNRWKRQNFHEFPPLFAFPSLSQTDLEELTYFFPEDHAEDVQQEFFPSWPTPSGLTEYSTLTLCQETLANSSIGRLCLAFLGKRLDSVIEMCVKDVLLKDDLSWAEAGVALLENECEKRIVEEGKYNTEEYGTSIEDILSVLKCPNLCSGNGQCMEWGCACSPSFSSYDCSDSYDKAPEITELGNAGFCDVQKYNCMMVRVFGKGFKELPSIKCEVTKLQYNSSEWMPGEPIYTQTVFHNSRAVDCQLPTDVQQFDTMDLVGGKPTGKWQLKVSNDGYKFSNPKITVIYDGACQVCGLYKNDSCTIKENVCIIDGLCYVEGDKNPTSPCLICRPKISRFTWSFLENNQPPVIQALQDKLQTFYGENFEYQFVAFDPEGSDIHFTLDSGPEGASVSSAGLFMWKTDLLTTQQITVRLNDDCDAETRVTIEVTVKSCDCLNGGSCVSDRNFSPGSGVYLCVCLPGFHGSLCEVDISGCQSNPCGLGSYISGFHSYSCDCPPELKVETQFVNQFTTQTVVLTRSDKSVNKEEDDKNAQGRKRHVKPTSGNAFTICKYPCGKSRECVAPNICKCKPGYIGSNCQTALCDPDCKNHGKCIKPNICQCLPGHGGATCDEEHCNPPCQHGGTCLAGNLCTCPYGFVGPRCETMVCNRHCENGGQCLTPDICQCKPGWYGPTCSTALCDPVCLNGGSCNKPNTCLCPNGFFGEHCQNAFCHPPCKNGGHCMRNNVCVCREGYTGRRFQKSICDPTCMNGGKCVGPSTCSCPSGWSGKRCNTPICLQKCKNGGECIAPSICHCPSSWEGVRCQIPICNPKCLYGGRCIFPNVCSCRTEYSGVKCEKKIQIRRH

SEQ ID NO: 1956 - protein, 207 aa, Homo sapiens
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHTFKYWKERHLKQIQIGLDQQAEYLNQCLEEDKNENEDMKEMKENEMKPSEARVPQLSSLELRRYFHRIDNFLKEKKYSDCAWEIVRVEIRRCLYYFYKFTALFRRK

SEQ ID NO: 1957 - protein, 312 aa, Homo sapiens
MESALPAAGFLYWVGAGTVAYLALRISYSLFTALRVWGVGNEAGVGPGLGEWAVVTGSTDGIGKSYAEELAKHGMKVVLISRSKDKLDQVSSEIKEKFKVETRTIAVDFASEDIYDKIKTGLAGLEIGILVNNVGMSYEYPEYFLDVPDLDNVIKKMININILSVCKMTQLVLPGMVERSKGAILNISSGSGMLPVPLLTIYSATKTFVDFFSQCLHEEYRSKGVFVQSVLPYFVATKLAKIRKPTLDKPSPETFVKSAIKTVGLQSRTNGYLIHALMGSIISNLPSWIYLKIVMNMNKSTRAHYLKKTKKN

SEQ ID NO: 1958 - protein, 737 aa, Homo sapiens
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEAGKSKIKASEDSLSVLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 1959 - protein, 500 aa, Homo sapiens
MGTARWLALGSLFALAGLLEGRLVGEEEAGFGECDKFFYAGTPPAGLAADSHVKICQRAEGAERFATLYSTRDRIPVYSAFRAPRPAPGGAEQRWLVEPQIDDPNSNLEEAINEAEAITSVNSLGSKQALNTDYLDSDYQRGQLYPFSLSSDVQVATFTLTNSAPMTQSFQERWYVNLHSLMDRALTPQCGSGEDLYILTGTVPSDYRVKDKVAVPEFVWLAACCAVPGGGWAMGFVKHTRDSDIIEDVMVKDLQKLLPFNPQLFQNNCGETEQDTEKMKKILEVVNQIQDEERMVQSQKSSSPLSSTRSKRSTLLPPEASEGSSSFLGKLMGFIATPFIKLFQLIYYLVVAILKNIVYFLWCVTKQVINGIESCLYRLGSATISYFMAIGEELVSIPWKVLKVVAKVIRALLRILCCLLKAICRVLSIPVRVLVDVATFPVYTMGAIPIVCKDIALGLGGTVSLLFDTAFGTLGGLFQVVFSVCKRIGYKVTFDNSGEL

SEQ ID NO: 1960 - protein, 99 aa, Homo sapiens
MKSAKLGFLLRFFIFCSLNTLLLGGVNKIAEKICGDLKDPCKLDMNFGSCYEVHFRYFYNRTSKRCETFVFSGCNGNLNNFKLKIEREVACVAKYKPPR

SEQ ID NO: 1961 - protein, 129 aa, Homo sapiens
MPMASPQTLVLYLLVLAVTEAWGQEAVIPGCHLHPFNVTVRSDRQGTCQGSHVAQACVGHCESSAFPSRYSVLVASGYRHNITSVSQCCTISGLKKVKVQLQCVGSRREELEIFTARACQCDMCRLSRY

SEQ ID NO: 1962 - protein, 654 aa, Homo sapiens
MAKFGVHRILLLAISLTKCLESTKLLADLKKCGDLECEALINRVSAMRDYRGPDCRYLNFTKGEEISVYVKLAGEREDLWAGSKGKEFGYFPRDAVQIEEVFISEEIQMSTKESDFLCLLGVSYTFDNEDSELNGDYGENIYPYEEDKDEKSSIYESDFQIEPGFYATYESTLFEDQVPALEAPEDIGSTSESKDWEEVVVESMEQDRIPEVHVPPSSAVSGVKEWFGLGGEQAEEKAFESVIEPVQESSFRSRKIAVEDENDLEELNNGEPQTEHQQESESEIDSVPKTQSELASESEHIPKPQSTGWFGGGFTSYLGFGDEDTGLELIAEESNPPLQDFPNSISSDKEATVPCTEILTEKKDTITNDSLSLKPSWFDFGFAILGFAYAKEDKIMLDDRKNEEDGGADEHEHPLTSELDPEKEQEIETIKIIETEDQIDKKPVSEKTDESDTIPYLKKFLYNFDNPWNFQNIPKETELPFPKQILDQNNVIENEETGEFSIDNYPTDNTKVMIFKSSYSLSDMVSNIELPTRIHEEVYFEPSSSKDSDENSKPSVDTEGPALVEIDRSVENTLLNSQMVSTDNSLSSQNYISQKEDASEFQILKYLFQIDVYDFMNSAFSPIVILTERVSLPFKPFAIILPILLNIRVATKYV

SEQ ID NO: 1963 - protein, 383 aa, Homo sapiens
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 1964 - protein, 553 aa, Homo sapiens
MKWCWGPVLLIAGATVLMEGLQAAQRACGQRGPGPPKPQEGNTVPGEWPWQASVRRQGAHICSGSLVADTWVLTAAHCFEKAAATELNSWSVVLGSLQREGLSPGAEEVGVAALQLPRAYNHYSQGSDLALLQLAHPTTHTPLCLPQPAHRFPFGASCWATGWDQDTSDAPGTLRNLRLRLISRPTCNCIYNQLHQRHLSNPARPGMLCGGPQPGVQGPCQGDSGGPVLCLEPDGHWVQAGIISFASSCAQEDAPVLLTNTAAHSSWLQARVQGAAFLAQSPETPEMSDEDSCVACGSLRTAGPQAGAPSPWPWEARLMHQGQLACGGALVSEEAVLTAAHCFIGRQAPEEWSVGLGTRPEEWGLKQLILHGAYTHPEGGYDMALLLLAQPVTLGASLRPLCLPYPDHHLPDGERGWVLGRARPGAGISSLQTVPVTLLGPRACSRLHAAPGGDGSPILPGMVCTSAVGELPSCEGLSGAPLVHEVRGTWFLAGLHSFGDACQGPARPAVFTALPAYEDWVSSLDWQVYFAEEPEPEAEPGSCLANISQPTSC

SEQ ID NO: 1965 - protein, 311 aa, Homo sapiens
MGIIQSILATSRDCYSFKKKPIPKKPTMLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKVLRLDNAPEPYDVSFGNSSYYNPTLNDSAMPESEENARDGIPMDDIPPLRTSV

SEQ ID NO: 1966 - protein, 1039 aa, Homo sapiens
MQSRLLLLGAPGGHGGPASRRMRLLLRQVVQRRPGGDRQRPEVRLLHAGSGADTGDTVNIGDVSYKLKIPKNPELVPQNYISDSLAQSVVQHLRWIMQKDLLGQDVFLIGPPGPLRRSIAMQYLELTKREVEYIALSRDTTETDLKQRREIRAGTAFYIDQCAVRAATEGRTLILEGLEKAERNVLPVLNNLLENREMQLEDGRFLMSAERYDKLLRDHTKKELDSWKIVRVSENFRVIALGLPVPRYSGNPLDPPLRSRFQARDIYYLPFKDQLKLLYSIGANVSAEKVSQLLSFATTLCSQESSTLGLPDFPLDSLAAAVQILDSFPMMPIKHAIQWLYPYSILLGHEGKMAVEGVLKRFELQDSGSSLLPKEIVKVEKMMENHVSQASVTIRIADKEVTIKVPAGTRLLSQPCASDRFIQTLSHKQLQAEMMQSHMVKDICLIGGKGCGKTVIAKNFADTLGYNIEPIMLYQDMTARDLLQQRYTLPNGDTAWRSSPLVNAALEGKLVLLDGIHRVNAGTLAVLQRLIHDRELSLYDGSRLLREDRYMRLKEELQLSDEQLQKRSIFPIHPSFRIIALAEPPVIGSTAHQWLGPEFLTMFFFHYMKPLVKSEEIQVIKEKVPNVPQEALDKLLSFTHKLRETQDPTAQSLAASLSTRQLLRISRRLSQYPNENLHSAVTKACLSRFLPSLARSALEKNLADATIEINTDDNLEPELKDYKCEVTSGTLRIGAVSAPIYNAHEKMKVPDVLFYDNIQHVIVMEDMLKDFLLGEHLLLVGNQGVGKNKIVDRFLHLLNRPREYIQLHRDTTVQTLTLQPSVKDGLIVYEDSPLVKAVKLGHILVVDEADKAPTNVTCILKTLVENGEMILADGRRIVANSANVNGRENVVVIHPDFRMIVLANRPGFPFLGNDFFGTLGDIFSCHAVDNPKPHSELEMLRQYGPNVPEPILQKLVAAFGELRSLADQGIINYPYSTREVVNIVKHLQKFPTEGLSSVVRNVFDFDSYNNDMREILINTLHKYGIPIGAKPTSVQLAKE

SEQ ID NO: 1967 - protein, 266 aa, Homo sapiens
MRLLFLAVLRPHTGNAVTAQRVRAHLEAAGHVCVLKDAFDFESRSEIANLILAENCEAALALHLYRGGRLLQGHRIPFGVIFGGTDVNEDANQAEKNTVMGRVLEEARFAVAFTESMKEMAQAQWVDPVFTREVKAKVKRAAGVRLIGEMPQEDLHAVVKNCFAVVNSSVSEGMSAAILEAMDLEVPVLARNIPGNAAVVKHEVTGLLFSNPQEFVHLAKRLVSDPALEKEIVVNGREYVRMYHSWQVERDTYQQLIRKLEGSTED

SEQ ID NO: 1968 - protein, 825 aa, Homo sapiens
MFSGFNVFRVGISFVIMCIFYMPTVNSLPELSPQKYFSTLQPGKASLAYFCQADSPRTSVFLEELNEAVRPLQDYGISVAKVNCVKEEISRYCGKEKDLMKAYLFKGNILLREFPTDTLFDVNAIVAHVLFALLFSEVKYITNLEDLQNIENALKGKANIIFSYVRAIGIPEHRAVMEAAFVYGTTYQFVLTTEIALLESIGSEDVEYAHLYFFHCKLVLDLTQQCRRTLMEQPLTTLNIHLFIKTMKAPLLTEVAEDPQQVSTVHLQLGLPLVFIVSQQATYEADRRTAEWVAWRLLGKAGVLLLLRDSLEVNIPQDANVVFKRAEEGVPVEFLVLHDVDLIISHVENNMHIEEIQEDEDNDMEGPDIDVQDDEVAETVFRDRKRKLPLELTVELTEETFNATVMASDSIVLFYAGWQAVSMAFLQSYIDVAVKLKGTSTMLLTRINCADWSDVCTKQNVTEFPIIKMYKKGENPVSYAGMLGTEDLLKFIQLNRISYPVNITSIQEAEEYLSGELYKDLILYSSVSVLGLFSPTMKTAKEDFSEAGNYLKGYVITGIYSEEDVLLLSTKYAASLPALLLARHTEGKIESIPLASTHAQDIVQIITDALLEMFPEITVENLPSYFRLQKPLLILFSDGTVNPQYKKAILTLVKQKYLDSFTPCWLNLKNTPVGRGILRAYFDPLPPLPLLVLVNLHSGGQVFAFPSDQAIIEENLVLWLKKLEAGLENHITILPAQEWKPPLPAYDFLSMIDAATSQRGTRKVPKCMKETDVQENDKEQHEDKSAVRKEPIETLRIKHWNRSNWFKEAEKSFRRDKELGCSKVN

SEQ ID NO: 1969 - protein, 223 aa, Homo sapiens
MTWRHHVRLLFTVSLALQIINLGNSYQREKHNGGREEVTKVATQKHRQSPLNWTSSHFGEVTGSAEGWGPEEPLPYSWAFGEGASARPRCCRNGGTCVLGSFCVCPAHFTGRYCEHDQRRSECGALEHGAWTLRACHLCRCIFGALHCLPLQTPDRCDPKDFLASHAHGPSAGGAPSLLLLLPCALLHRLLRPDAPAHPRSLVPSVLQRERRPCGRPGLGHRL

SEQ ID NO: 1970 - protein, 439 aa, Homo sapiens
MPAIAVLAAAAAAWCFLQVESRHLDALAGGAGPNHGNFLDNDQWLSTVSQYDRDKYWNRFRDDDYFRNWNPNKPFDQALDPSKDPCLKVKCSPHKVCVTQDYQTALCVSRKHLLPRQKKGNVAQKHWVGPSNLVKCKPCPVAQSAMVCGSDGHSYTSKCKLEFHACSTGKSLATLCDGPCPCLPEPEPPKHKAERSACTDKELRNLASRLKDWFGALHEDANRVIKPTSSNTAQGRFDTSILPICKDSLGWMFNKLDMNYDLLLDPSEINAIYLDKYEPCIKPLFNSCDSFKDGKLSNNEWCYCFQKPGGLPCQNEMNRIQKLSKGKSLLGAFIPRCNEEGYYKATQCHGSTGQCWCVDKYGNELAGSRKQGAVSCEEEQETSGDFGSGGSVVLLDDLEYERELGPKDKEGKLRVHTRAVTEDDEDEDDDKEDEVGYIW

SEQ ID NO: 1971 - protein, 2623 aa, Homo sapiens
MKVKGRGITCLLVSFAVICLVATPGGKACPRRCACYMPTEVHCTFRYLTSIPDSIPPNVERINLGYNSLVRLMETDFSGLTKLELLMLHSNGIHTIPDKTFSDLQALQVLKMSYNKVRKLQKDTFYGLRSLTRLHMDHNNIEFINPEVFYGLNFLRLVHLEGNQLTKLHPDTFVSLSYLQIFKISFIKFLYLSDNFLTSLPQEMVSYMPDLDSLYLHGNPWTCDCHLKWLSDWIQEKPDVIKCKKDRSPSSAQQCPLCMNPRTSKGKPLAMVSAAAFQCAKPTIDSSLKSKSLTILEDSSSAFISPQGFMAPFGSLTLNMTDQSGNEANMVCSIQKPSRTSPIAFTEENDYIVLNTSFSTFLVCNIDYGHIQPVWQILALYSDSPLILERSHLLSETPQLYYKYKQVAPKPEDIFTNIEADLRADPSWLMQDQISLQLNRTATTFSTLQIQYSSDAQITLPRAEMRPVKHKWTMISRDNNTKLEHTVLVGGTVGLNCPGQGDPTPHVDWLLADGSKVRAPYVSEDGRILIDKSGKLELQMADSFDTGVYHCISSNYDDADILTYRITVVEPLVEAYQENGIHHTVFIGETLDLPCHSTGIPDASISWVIPGNNVLYQSSRDKKVLNNGTLRILQVTPKDQGYYRCVAANPSGVDFLIFQVSVKMKGQRPLEHDGETEGSGLDESNPIAHLKEPPGAQLRTSALMEAEVGKHTSSTSKRHNYRELTLQRRGDSTHRRFRENRRHFPPSARRIDPQHWAALLEKAKKNAMPDKRENTTVSPPPVVTQLPNIPGEEDDSSGMLALHEEFMVPATKALNLPARTVTADSRTISDSPMTNINYGTEFSPVVNSQILPPEEPTDFKLSTAIKTTAMSKNINPTMSSQIQGTTNQHSSTVFPLLLGATEFQDSDQMGRGREHFQSRPPITVRTMIKDVNVKMLSSTTNKLLLESVNTTNSHQTSVREVSEPRHNHFYSHTTQILSTSTFPSDPHTAAHSQFPIPRNSTVNIPLFRRFGRQRKIGGRGRIISPYRTPVLRRHRYSIFRSTTRGSSEKSTTAFSATVLNVTCLSCLPRERLTTATAALSFPSAAPITFPKADIARVPSEESTTLVQNPLLLLENKPSVEKTTPTIKYFRTEISQVTPTGAVMTYAPTSIPMEKTHKVNASYPRVSSTNEAKRDSVITSSLSGAITKPPMTIIAITRFSRRKIPWQQNFVNNHNPKGRLRNQHKVSLQKSTAVMLPKTSPALPRDKVSPFHFTTLSTSVMQIPSNTLTTAHHTTTKTHNPGSLPTKKELPFPPLNPMLPSIISKDSSTKSIISTQTAIPATTPTFPASVITYETQTERSRAQTIQREQEPQKKNRTDPNISPDQSSGFTTPTAMTPPVLTTAETSVKPSVSAFTHSPPENTTGISSTISFHSRTLNLTDVIEELAQASTQTLKSTIASETTLSSKSHQSTTTRKAIIRHSTIPPFLSSSATLMPVPISPPFTQRAVTDNVATPISGLMTNTVVKLHESSRHNAKPQQLVAEVATSPKVHPNAKFTIGTTHFIYSNLLHSTPMPALTTVKSQNSKLTPSPWAENQFWHKPYSEIAEKGKKPEVSMLATTGLSEATTLVSDWDGQKNTKKSDFDKKPVQEATTSKLLPFDSLSRYIFEKPRIVGGKAASFTIPANSDAFLPCEAVGNPLPTIHWTRVPSGLDLSKRKQNSRVQVLPNGTLSIQRVEIQDRGQYLCSASNLFGTDHLHVTLSVVSYPPRILERRTKEITVHSGSTVELKCRAEGRPSPTVTWILANQTVVSESSQGSRQAVVTVDGTLVLHNLSIYDRGFYKCVASNPGGQDSLLVKIQVIAAPPVILEQRRQVIVGTWGESLKLPCTAKGTPQPSVYWVLSDGTEVKPLQFTNSKLFLFSNGTLYIRNLASSDRGTYECIATSSTGSERRVVMLTMEERVTSPRIEAASQKRTEVNFGDKLLLNCSATGEPKPQIMWRLPSKAVVDQQHRVGSWIHVYPNGSLFIGSVTEKDSGVYLCVARNKMGDDLILMHVSLRLKPAKIDHKQYFRKQVLHGKDFQVDCKASGSPVPEISWSLPDGTMINNAMQADDSGHRTRRYTLFNNGTLYFNKVGVAEEGDYTCYAQNTLGKDEMKVHLTVITAAPRIRQSNKTNKRIKAGDTAVLDCEVTGDPKPKIFWLLPSNDMISFSIDRYTFHANGSLTINKVKLLDSGEYVCVARNPSGDDTKMYKLDVVSKPPLINGLYTNRTVIKATAVRHSKKHFDCRAEGTPSPEVMWIMPDNIFLTAPYYGSRITVHKNGTLEIRNVRLSDSADFICVARNEGGESVLVVQLEVLEMLRRPTFRNPFNEKIVAQLGKSTALNCSVDGNPPPEIIWILPNGTRFSNGPQSYQYLIASNGSFIISKTTREDAGKYRCAARNKVGYIEKLVILEIGQKPVILTYAPGTVKGISGESLSLHCVSDGIPKPNIKWTMPSGYVVDRPQINGKYILHDNGTLVIKEATAYDRGNYICKAQNSVGHTLITVPVMIVAYPPRITNRPPRSIVTRTGAAFQLHCVALGVPKPEITWEMPDHSLLSTASKERTHGSEQLHLQGTLVIQNPQTSDSGIYKCTAKNPLGSDYAATYIQVI

SEQ ID NO: 1972 - protein, 664 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 1973 - protein, 417 aa, Homo sapiens
MLALLVLVTVALASAHHGGEHFEGEKVFRVNVEDENHINIIRELASTTQIDFWKPDSVTQIKPHSTVDFRVKAEDTVTVENVLKQNELQYKVLISNLRNVVEAQFDSRVRATGHSYEKYNKWETIEAWTQQVATENPALISRSVIGTTFEGRAIYLLKVGKAGQNKPAIFMDCGFHAREWISPAFCQWFVREAVRTYGREIQVTELLDKLDFYVLPVLNIDGYIYTWTKSRFWRKTRSTHTGSSCIGTDPNRNFDAGWCEIGASRNPCDETYCGPAAESEKETKALADFIRNKLSSIKAYLTIHSYSQMMIYPYSYAYKLGENNAELNALAKATVKELASLHGTKYTYGPGATTIYPAAGGSDDWAYDQGIRYSFTFELRDTGRYGFLLPESQIRATCEETFLAIKYVASYVLEHLY

SEQ ID NO: 1974 - protein, 195 aa, Homo sapiens
MAVSQGDGTLCFVLLLCCWQETELRPRTVIPGSPTEIPFSSKQEDMSELLDEILVQEILDLNKTTPSEMPSTASTLSTPLHAGIDENYQAGGSENYHELLENLQFSPGIEVKISNDEANANANLHGDPSENYRGPQVSPGSEKSVSSKEKNSKNTQYENLSILDQILQNIGRSSGNIFHKEQQRTSAQRRSQGSQ

SEQ ID NO: 1975 - protein, 777 aa, Homo sapiens
MNANKDERLKARSQDFHLFPALMMLSMTMLFLPVTGTLKQNIPRLKLTYKDLLLSNSCIPFLGSSEGLDFQTLLLDEERGRLLLGAKDHIFLLSLVDLNKNFKKIYWPAAKERVELCKLAGKDANTECANFIRVLQPYNKTHIYVCGTGAFHPICGYIDLGVYKEDIIFKLDTHNLESGRLKCPFDPQQPFASVMTDEYLYSGTASDFLGKDTAFTRSLGPTHDHHYIRTDISEHYWLNGAKFIGTFFIPDTYNPDDDKIYFFFRESSQEGSTSDKTILSRVGRVCKNDVGGQRSLINKWTTFLKARLICSIPGSDGADTYFDELQDIYLLPTRDERNPVVYGVFTTTSSIFKGSAVCVYSMADIRAVFNGPYAHKESADHRWVQYDGRIPYPRPGTCPSKTYDPLIKSTRDFPDDVISFIKRHSVMYKSVYPVAGGPTFKRINVDYRLTQIVVDHVIAEDGQYDVMFLGTDIGTVLKVVSISKEKWNMEEVVLEELQIFKHSSIILNMELSLKQQQLYIGSRDGLVQLSLHRCDTYGKACADCCLARDPYCAWDGNACSRYAPTSKRRARRQDVKYGDPITQCWDIEDSISHETADEKVIFGIEFNSTFLECIPKSQQATIKWYIQRSGDEHREELKPDERIIKTEYGLLIRSLQKKDSGMYYCKAQEHTFIHTIVKLTLNVIENEQMENTQRAEHEEGKVKDLLAESRLRYKDYIQILSSPNFSLDQYCEQMWHREKRRQRNKGGPKWKHMQEMKKKRNRRHHRDLDELPRAVAT

SEQ ID NO: 1976 - protein, 443 aa, Homo sapiens
MQPSEMVMNPKQVFLSVLIFGVAGLLLFMYLQVWIEEQHTGRVEKRREQKVTSGWGPVKYLRPVPRIMSTEKIQEHITNQNPKFHMPEDVREKKENLLLNSERSTRLLTKTSHSQGGDQALSKSTGSPTEKLIEKRQGAKTVFNKFSNMNWPVDIHPLNKSLVKDNKWKKTEETQEKRRSFLQEFCKKYGGVSHHQSHLFHTVSRIYVEDKHKILYCEVPKAGCSNWKRILMVLNGLASSAYNISHNAVHYGKHLKKLDSFDLKGIYTRLNTYTKAVFVRDPMERLVSAFRDKFEHPNSYYHPVFGKAIIKKYRPNACEEALINGSGVKFKEFIHYLLDSHRPVGMDIHWEKVSKLCYPCLINYDFVGKFETLEEDANYFLQMIGAPKELKFPNFKDRHSSDERTNAQVVRQYLKDLTRTERQLIYDFYYLDYLMFNYTTPFL

SEQ ID NO: 1977 - protein, 1075 aa, Homo sapiens
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 1978 - protein, 160 aa, Homo sapiens [sequence omitted]

SEQ ID NO: 1979 - protein, 259 aa, Homo sapiens
MAALMRSKDSSCCLLLLAAVLMVESSQIGSSRAKLNSIKSSLGGETPGQAANRSAGMYQGLAFGGSKKGKNLGQAYPCSSDKECEVGRYCHSPHQGSSACMVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 1980 - protein, 1009 aa, Homo sapiens
MGQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPQDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEAVLQALGSVVAVEERSLTGTWDLSMLHRWSWRTGPGRHRGDTTSPSRPPGGPIITVHPKEIRTFFIHFQQQ

SEQ ID NO: 1981 - protein, 480 aa, Homo sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 1982 - protein, 446 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQARAALCGTPTPSLASGLWRTLQVGWNMQLLPAGLVSFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNDQRCKTRNRYICQFAQEHISRWGPGS

SEQ ID NO: 1983 - protein, 770 aa, Homo sapiens
MVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKDRPAVEKARTLYRSCMNQSVIEKRGSQPLLDILEVVGGWPVAMDRWNETVGLEWELERQLALMNSQFNRRVLIDLFIWNDDQNSSRHIIYIDQPTLGMPSREYYFNGGSNRKVREAYLQFMVSVATLLREDANLPRDSCLVQEDMVQVLELETQLAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKYRVLGSLQNLAAFADTFHCARGTPMHPKERCRVW

SEQ ID NO: 1984 - protein, 438 aa, Homo sapiens
MSKRDKAGKDTARGKGKDISKYGSVQKSFADRGLPKPPKEKLLQVEKLRKESGKGSFLQPTAKPRALAQQQAVIRGFTYYKAGKQEVTEAVADNTLQGTSWLEQLPPKVEGRSNSAEPNSAEQDEAEPRSSERVDLASGTPTSIPATTTTATTTPTPTTSLLPTEPPSGPEVSSQGREASCEGTLRAVDPPVRHHSYGRHEGAWMKDPAARDDRIYVTNYYYGNSLVEFRNLENFKQGRWSNMYKLPYNWIGTGHVVYQGAFYYNRAFTKNIIKYDLRQRFVASWALLPDVVYEDTTPWKWRGHSDIDFAVDESGLWVIYPAVDDRDEAQPEVIVLSRLDPGDLSVHRETTWKTRLRRNSYGNCFLVCGILYAVDTYNQQEGQVAYAFDTHTGTDARPQLPFLNEHAYTTQIDYNPKERVLYAWDNGHQLTYTLHFVV

SEQ ID NO: 1985 - protein, 1189 aa, Homo sapiens
MPGLLNWITGAALPLTASDVTSCVSGYALGLTASLTYGNLEAQPFQGLFVYPLDECTTVIGFEAVIADRVVTVQIKDKAKLESGHFDASHVRSPTVTGNILQDGVSIAPHSCTPGKVTLDEDLERILFVANLGTIAPMENVTIFISTSSELPTLPSGAVRVLLPAVCAPTVPQFCTKSTGTSNQQAQGKDRHCFGAWAPGSWNKLCLATLLNTEVSNPMEYEFNFQLEIRGPCLLAGVESPTHEIRADAAPSARSAKSIIITLANKHTFDRPVEILIHPSEPHMPHVLIEKGDMTLGEFDQHLKGRTDFIKGMKKKSRAERKTEIIRKRLHKDIPHHSVIMLNFCPDLQSVQPCLRKAHGEFIFLIDRSSSMSGISMHRVKDAMLVALKSLMPACLFNIIGFGSTFKSLFPSSQTYSEDSLAMACDDIQRMKADMGGTNILSPLKWVIRQPVHRGHPRLLFVITDGAVNNTGKVLELVRNHAFSTRCYSFGIGPNVCHRLVKGLASVSEGSAELLMEGERLQPKMVKSLKKAMAPVLSDVTVEWIFPETTEVLVSPVSASSLFPGERLVGYGIVCDASLHISNPRSDKRRRYSMLHSQESGSSVFYHSQDDGPGLEGGDCAKNSGAPFILGQAKNARLASGDSTTKHDLNLSQRRRAYSTNQITNHKPLPRATMASDPMPAAKRYPLRKARLQDLTNQTSLDVQRWQIDLQPLLNSGQDLNQGPKLRGPGARRPSLLPQGCQPFLPWGQETQAWSPVRERTSDSRSPGDLEPSHHPSAFETETSSDWDPPAESQERASPSRPATPAPVLGKALVKGLHDSQRLQWEVSFELGTPGPERGGAQDADLWSETFHHLAARAIIRDFEQLAEREGEIEQGSNRRYQVSALHTSKACNIISKYTAFVPVDVSKSRYLPTVVEYPNSAALRMLGSRALAQQWRGTSSGFGRPQTMLGEDSAPGNGPQRSLATNTLSSMKASENLFGSWLNLNKSRLLTRAAKGFLSKPLIKAVESTSGNQSFDYIPLVSLQLASGAFLLNEAFCEATHIPMEKLKWTSPFTCHRVSLTTRPSESKTPSPQLCTSSPPRHPSCDSFSLEPLAKGKLGLEPRAVVEHTGKLWATVVGLAWLEHSSASYFTEWELVAAKANSWLEQQEVPEGRTQGTLKAAARQLFVLLRHWDENLEFNMLCYNPNYV

SEQ ID NO: 1986 - protein, 447 aa, Homo sapiens
MPHVLIEKGDMTLGEFDQHLKGRTDFIKGMKKKSRAERKTEIIRKRLHKDIPHHSVIMLNFCPDLQSVQPCLRKAHGEFIFLIDRSSSMSGISMHRVKDAMLVALKSLMPACLFNIIGFGSTFKSLFPSSQTYSEDSLAMACDDIQRMKADMGGTNILSPLKWVIRQPVHRGHPRLLFVITDGAVNNTGKVLELVRNHAFSTRCYSFGIGPNVCHRLVKGLASVSEGSAELLMEGERLQPKMVKSLKKAMAPVLSDVTVEWIFPETTEVLVSPVSASSLFPGERLVGYGIVCDASLHISNPRSDKRRRYSMLHSQESGSSVFYHSQDDGPGLEGGDCAKNSGAPFILGQAKNARLASGDSTTKHDLNLSQRRRAYSTNQITNHKPLPRATMASDPMPAAKRYPLRKARLQDLTNQTSLDVQRWQIDLQAFICLTSEDTFQIRTPTGQ

SEQ ID NO: 1987 - protein, 241 aa, Homo sapiens
MWTVRTEGGHFPLHSPTFSWRNVAFLLLLSLALEWTSAMLTKKIKHKPGLCPKERLTCTTELPDSCNTDFDCKEYQKCCFFACQKKCMDPFQEPCMLPVRHGNCNHEAQRWHFDFKNYRCTPFKYRGCEGNANNFLNEDACRTACMLIVKDGQCPLFPFTERKECPPSCHSDIDCPQTDKCCESRCGFVCARAWTVKKGFCPRKPLLCTKIDKPKCLQDEECPLVEKCCSHCGLKCMDPRR

SEQ ID NO: 1988 - protein, 357 aa, Homo sapiens
MRPPPALALAGLCLLALPAAAASYFGLTGREVLTPFPGLGTAAAPAQGGAHLKQCDLLKLSRRQKQLCRREPGLAETLRDAAHLGLLECQFQFRHERWNCSLEGRMGLLKRGFKETAFLYAVSSAALTHTLARACSAGRMERCTCDDSPGLESRQAWQWGVCGDNLKYSTKFLSNFLGSKRGNKDLRARADAHNTHVGIKAVKSGLRTTCKCHGVSGSCAVRTCWKQLSPFRETGQVLKLRYDSAVKVSSATNEALGRLELWAPARQGSLTKGLAPRSGDLVYMEDSPSFCRPSKYSPGTAGRVCSREASCSSLCCGRGYDTQSRLVAFSCHCQVQWCCYVECQQCVQEELVYTCKH

SEQ ID NO: 1989 - protein, 269 aa, Homo sapiens
MVRCLGPALLLLLLLGSASSVGGNRCVDAAEACTADARCQRLRSEYVAQCLGRAAQGGCPRARCRRALRRFFARGPPALTHALLFCPCAGPACAERRRQTFVPSCAFSGPGPAPPSCLEPLNFCERSRVCRPRLLAFQVSCTPAPSAPDGCLLDQGARCLRAYAGLVGTAVTPNYVDNVSARVAPWCDCGASGNRREDCEAFRGLFTRNRCLDGAIQAFASGWPPVLLDQLNPQGDPEHSLLQVSSTGRALERRSLLSILPVLALPALL

SEQ ID NO: 1990 - protein, 575 aa, Homo sapiens
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 1991 - protein, 341 aa, Homo sapiens
MGTLPWLLAFFILGLQAWDTPTIVSRKEWGARPLACRALLTLPVAYIITDQLPGMQCQQQSVCSQMLRGLQSHSVYTIGWCDVAYNFLVGDDGRVYEGVGWNIQGLHTQGYNNISLGIAFFGNKIGSSPSPAALSAAEGLISYAIQKGHLSPRYIQPLLLKEETCLDPQHPVMPRKVCPNIIKRSAWEARETHCPKMNLPAKYVIIIHTAGTSCTVSTDCQTVVRNIQSFHMDTRNFCDIGYHFLVGQDGGVYEGVGWHIQGSHTYGFNDIALGIAFIGYFVEKPPNAAALEAAQDLIQCAVVEGYLTPNYLLMGHSDVVNILSPGQALYNIISTWPHFKH

SEQ ID NO: 1992 - protein, 298 aa, Homo sapiens
MGIVCAQCSFILLLSIIRARPPPFLFCPLSSQRTESPYKPVHLGLGPTDKVAAIAMARIIDLVPWDDGSTHVYASPAILLPMERQRNQLAGVKQQLYHPALPTLRHMDRDTVKACLPDEHCQSTTYCRKDEFDNAHFTLLGVPNKPLQCLDITATGQKLRNRYHEGKLAPIAPGINRVDWPCFTRAIEDWSHFVSSAGEFKLPCLRKRAEGLSGYAVRYLKPDVTQTWRQEALCGAWAGRPCSPDSPRPYPCCPPQYCLSQNPSLDRYGQKPLPFDSLNTFRSFGSSYSRVNYLTPWH

SEQ ID NO: 1993 - protein, 1932 aa, Homo sapiens
MAPGALRGGCEQRAPGGGARTAALGPWPWPSPGPAPSPGAAPPRSRKMSGALLWPLLPLLLLLLSARDGVRAAQPQAPGYLIAAPSVFRAGVEEVISVTIFNSPREVTVQAQLVAQGEPVVQSQGAILDKGTIKLKVPTGLRGQALLKVWGRGWQAEEGPLFHNQTSVTVDGRGASVFIQTDKPVYRPQHRVLISIFTVSPNLRPVNEKLEAYILDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALMINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLETKVMALNGKPVGAQYLPSYLSLGSWYSPSQCYLQLQPPSHPLQVGEEAYFSVKSTCPCNFTLYYEVAARGNIVLSGQQPAHTTQQRSKRAAPALEKPIRLTHLSETEPPPAPEAEVDVCVTSLHLAVTPSMVPLGRLLVFYVRENGEGVADSLQFAVETFFENQVSVTYSANETQPGEVVDLRIRAARGSCVCVAAVDKSVYLLRSGFRLTPAQVFQELEDYDVSDSFGVSREDGPFWWAGLTAQRRRRSSVFPWPWGITKDSGFAFTETGLVVMTDRVSLNHRQDGGLYTDEAVPAFQPHTGSLVAVAPSRHPPRTEKRKRTFFPETWIWHCLNISDPSGEGTLSVKVPDSITSWVGEAVALSTSQGLGIAEPSLLKTFKPFFVDFMLPALIIRGEQVKIPLSVYNYMGTCAEVYMKLSVPKGIQFVGHPGKRHVTKKMCVAPGEAEPIWVVLSFSDLGLNNITAKALAYGDTNCCRDGRSSKHPEENHADRRVPIGVDHVRRSVMVEAEGVPRAYTYSAFFCPSERVHISTPNKYEFQYVQRPLRLTRFDVAVRAHNDARVALSSGPQDTAGMIEIVLGGHQNTRSWISTSKMGEPVASAHTAKILSWDEFRTFWISWRGGLIQVGHGPEPSNESVIVAWTLPRPPEVQFIGFSTGWGSMGEFRIWRKMEVDESYSEAFTLGVPHGAIPGSERATASIIGDVMGPTLNHLNNLLRLPFGCGEQNMIHFAPNVFVLKYLQKTQQLSPEVERETTDYLVQGYQRQLTYKRQDGSYSAFGERDASGSMWLTAFVLKSFAQARSFIFVDPRELAAAKSWIIQQQQADGSFLAVGRVLNKDIQGGIHGTVPLTAYVVVALLETGTASEEERGSTDKARHFLESAAPLAMDPYSCALTTYALTLLRSPAAPEALRKLRSLAIMRDGVTHWSLSNSWDVDKGTFLSFSDRVSQSVVSAEVEMTAYALLTYTLLGDVAAALPVVKWLSQQRNALGGFSSTQDTCVALQALAEYAILSYAGGINLTVSLASTNLDYQETFELHRTNQKVLQTAAIPSLPTGLFVSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALEQRLPASSSSTYGDDLASVAPGPLQQDVKLNGAGLEVEDSDPEPEGEAEDRVTAGPRPPVSSGNLESSTQSASPFHRWGQTPAPQRHSGRVVGAHRPGLLSPVFVYSPAFQSGGEEGLWMSNTCTLR

SEQ ID NO: 1994 - protein, 402 aa, Homo sapiens
MVCARAALGPGALWAAAWGVLLLTAPAGAQRGRKKVVHVLEGESGSVVVQTAPGQVVSHRGGTIVLPCRYHYEAAAHGHDGVRLKWTKVVDPLAFTDVFVALGPQHRAFGSYRGRAELQGDGPGDASLVLRNVTLQDYGRYECEVTNELEDDAGMVKLDLEGVVFPYHPRGGRYKLTFAEAQRACAEQDGILASAEQLHAAWRDGLDWCNAGWLRDGSVQYPVNRPREPCGGLGGTGSAGGGGDANGGLRNYGYRHNAEERYDAFCFTSNLPGRVFFLKPLRPVPFSGAARACAARGAAVAKVGQLFAAWKLQLLDRCTAGWLADGSARYPIVNPRARCGGRRPGVRSLGFPDATRRLFGVYCYRAPGAPDPAPGGWGWGWAGGGGWAGGARDPAAWTPLHV

SEQ ID NO: 1995 - protein, 579 aa, Homo sapiens
MSALRPLLLLLLPLCPGPGPGPGSEAKVTRSCAETRQVLGARGYSLNLIPPALISGEHLRVCPQEYTCCSSETEQRLIRETEATFRGLVEDSGSFLVHTLAARHRKFDEFFLEMLSVAQHSLTQLFSHSYGRLYAQHALIFNGLFSRLRDFYGESGEGLDDTLADFWAQLLERVFPLLHPQYSFPPDYLLCLSRLASSTDGSLQPFGDSPRRLRLQITRTLVAARAFVQGLETGRNVVSEALKVPVSEGCSQALMRLIGCPLCRGVPSLMPCQGFCLNVVRGCLSSRGLEPDWGNYLDGLLILADKLQGPFSFELTAESIGVKISEGLMYLQENSAKVSAQVFQECGPPDPVPARNRRAPPPREEAGRLWSMVTEEERPTTAAGTNLHRLVWELRERLARMRGFWARLSLTVCGDSRMAADASLEAAPCWTGAGRGRYLPPVVGGSPAEQVNNPELKVDASGPDVPTRRRRLQLRAATARMKTAALGHDLDGQDADEDASGSGGGQQYADDWMAGAVAPPARPPRPPYPPRRDGSGGKGGGGSARYNQGRSRSGGASIGFHTQTILILSLSALALLGPR

SEQ ID NO: 1996 - protein, 165 aa, Homo sapiens
MALLALLLVVALPRVWTDANLTARQRDPEDSQRTDEGDNRVWCHVCERENTFECQNPRRCKWTEPYCVIAAVKIFPRFFMVAKQCSAGCAAMERPKPEEKRFLLEEPMPFFYLKCCKIRYCNLEGPPINSSVFKEYAGSMGESCGGLWLAILLLLASIAAGLSLS

SEQ ID NO: 1997 - protein, 310 aa, Homo sapiens
MNGLSLSELCCLFCCPPCPGRIAAKLAFLPPEATYSLVPEPEPGPGGAGAAPLGTLRASSGAPGRWKLHLTERADFQYSQRELDTIEVFPTKSARGNRVSCMYVRCVPGARYTVLFSHGNAVDLGQMSSFYIGLGSRLHCNIFSYDYSGYGASSGRPSERNLYADIDAAWQALRTRYGISPDSIILYGQSIGTVPTVDLASRYECAAVVLHSPLTSGMRVAFPDTKKTYCFDAFPNIEKVSKITSPVLIIHGTEDEVIDFSHGLALYERCPKAVEPLWVEGAGHNDIELYSQYLERLRRFISQELPSQRA

SEQ ID NO: 1998 - protein, 634 aa, Homo sapiens
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYSFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTAVSLRSLHYTARRPSVYTSSTRPLPPACNSCARTASARPPTSRRHVYSGNLGPAFAGHSAGNIPDPVTSAYAASAQPQTQPACPFPSS

SEQ ID NO: 1999 - protein, 258 aa, Homo sapiens
MLVLYGHSTQDLPETNARVVGGTEAGRNSWPSQISLQYRSGGSRYHTCGGTLIRQNWVMTAAHCVDYQKTFRVVAGDHNLSQNDGTEQYVSVQKIVVHPYWNSDNVAAGYDIALLRLAQSVTLNSYVQLGVLPQEGAILANNSPCYITGWGKTKTNGQLAQTLQQAYLPSVDYAICSSSSYWGSTVKNTMVCAGGDGVRSGCQGDSGGPLHCLVNGKYSVHGVTSFVSSRGCNVSRKPTVFTQVSAYISWINNVIASN

SEQ ID NO: 2000 - protein, 330 aa, Homo sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 2001 - protein, 750 aa, Homo sapiens
MAKPRLLVLYFALIVVPAWVSSIVLTGTSEPPDAQTVAPAEDETLQNEADNQENVLSQLLGDYDKVKAMSEGSDCQCKCVVRPLGRDACQRINAGASRKEDFYTVETITSGSSCKCACVAPPSALNPCEGDFRLQKLREADSQDLKLSTIIDMLEGAFYGLDLLKLHSVTTKLVGRVDKLEEEVSKNLTKENEQIKEDMEEIRTEMNKRGKENCSENILDSMPDIRSALQRDAAAAYAHPEYEERFLQEETVSQQINSIELLQTRPLALPEVVKSQRPLQRQVHLRGRPASQPTVIRGITYYKAKVSEEENDIEEQQDEFFSGDNGVDLLIEDQLLRHNGLMTSVTRRPAATRQGHSTAVTSDLNARTAPWSSALPQPSTSDPSIANHASVGPTLQTTSVSPDPTRESVLQPSPQVPATTVAHTATQQPAAPAPPAVSPREALMEAMHTVPVPPTTVRTDSLGKDAPAGWGTTPASPTLSPEEEDDIRNVIGRCKDTLSTITGPTTQNTYGRNEGAWMKDPLAKDERIYVTNYYYGNTLVEFRNLENFKQGRWSNSYKLPYSWIGTGHVVYNGAFYYNRAFTRNIIKYDLKQRYVAAWAMLHDVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 2002 - protein, 225 aa, Homo sapiens
MKLGCVLMAWALYLSLGVLWVAQMLLAAGCHAELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 2003 - protein, 296 aa, Homo sapiens
MSRQEPKMFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDRGEQGDPGLPGVCRCGSIVLKSAFSVGITTSYPEERLPIIFNKVLFNEGEHYNPATGKFICAFPGIYYFSYDITLANKHLAIGLVHNGQYRIKTFDANTGNHDVASGSTVIYLQPEDEVWLEIFFTDQNGLFSDPGWADSLFSGFLLYVDTDYLDSISEDDEL

SEQ ID NO: 2004 - protein, 424 aa, Homo sapiens
MGSLVLTLCALFCLAAYLVSGSPIMNLEQSPLEEDMSLFGDVFSEQDGVDFNTLLQSMKDEFLKTLNLSDIPTQDSAKVDPPEYMLELYNKFATDRTSMPSANIIRSFKNEDLFSQPVSFNGLRKYPLLFNVSIPHHEEVIMAELRLYTLVQRDRMIYDGVDRKITIFEVLESKGDNEGERNMLVLVSGEIYGTNSEWETFDVTDAIRRWQKSGSSTHQLEVHIESKHDEAEDASSGRLEIDTSAQNKHNPLLIVFSDDQSSDKERKEELNEMISHEQLPELDNLGLDSFSSGPGEEALLQMRSNIIYDSTARIRRNAKGNYCKRTPLYIDFKEIGWDSWIIAPPGYEAYECRGVCNYPLAEHLTPTKHAIIQALVHLKNSQKASKACCVPTKLEPISILYLDKGVVTYKFKYEGMAVSECGCR

SEQ ID NO: 2005 - protein, 126 aa, Homo sapiens
MHLSQLLACALLLTLLSLRPSEAKPGAPPKVPRTPPAEELAEPQAAGGGQKKGDKAPGGGGANLKGDRSRLLRDLRVDTKSRAAWARLLQEHPNARKYKGANKKGLSKGCFGLKLDRIGSMSGLGC

SEQ ID NO: 2006 - protein, 140 aa, Homo sapiens
MRSPRMRVCAKSVLLSHWLFLAYVLMVCCKLMSASSQHLRGHAGHHQIKQGTCEVVAVHRCCNKNRIEERSQTVKCSCFPGQVAGTTRAQPSCVEASIVIQKWWCHMNPCLEGEDCKVLPDYSGWSCSSGNKVKTTKVTR

SEQ ID NO: 2007 - protein, 443 aa, Homo sapiens
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMHVLCQPKETSDSSLVCSRYLQYCRATNLYLDLRNIKRNHDRFKEDFFQSGEIGGHCKLDIRTLTSEGQRKSPLQSWFAELQSYTQLNFRPIEDAKCDIVIEKPTYFMKLDAGVNMYHHFCDFINLYITQHVNNSFSTDVYIVMWDTDGKIRVTILARSTEYRKILNQNELVNALKTVSTFEVQIVDYKYRELGFLDQLRITHNTDIFIGMHGAGLTHLLFLPDWAAVFELYNCEDERCYLDLARLRGVHYITWRRQNKVFPQDKGHHPTLGEHPKFTNYSFDVEEFMYLVLQAADHVLQHPKWPFKKKHDEL

SEQ ID NO: 2008 - protein, 111 aa, Homo sapiens
MGPSSCLLLILIPLLQLINPGSTQCSLDSVMDKKIKDVLNSLEYSPSPISKKLSCASVKSQGRPSSCPAGMAVTGCACGYGCGSWDVQLETTCHCQCSVVDWTTARCCHLT

SEQ ID NO: 2009 - protein, 654 aa, Homo sapiens
MAPKKLSCLRSLLLPLSLTLLLPQADTRSFVVDRGHDRFLLDGAPFRYVSGSLHYFRVPRVLWADRLLKMRWSGLNAIQFYVPWNYHEPQPGVYNFNGSRDLIAFLNEAALANLLVILRPGPYICAEWEMGGLPSWLLRKPEIHLRTSDPDFLAAVDSWFKVLLPKIYPWLYHNGGNIISIQVENEYGSYRACDFSYMRHLAGLFRALLGEKILLFTTDGPEGLKCGSLRGLYTTVDFGPADNMTKIFTLLRKYEPHGPLVNSEYYTGWLDYWGQNHSTRSVSAVTKGLENMLKLGASVNMYMFHGGTNFGYWNGADKKGRFLPITTSYDYDAPISEAGDPTPKLFALRDVISKFQEVPLGPLPPPSPKMMLGPVTLHLVGHLLAFLDLLCPRGPIHSILPMTFEAVKQDHGFMLYRTYMTHTIFEPTPFWVPNNGVHDRAYVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 2010 - protein, 833 aa, Homo sapiens
MNMEIGHPHEGKDDLGDKRVIMGTKFPMELGIRVGLGKEDSRCGESPVVSNKCEGRMAPPETKFPLSKGLEMGLERQNISRTVMQRGSLGVDSVSASQGTKPSLLPGRMGLENESLLAGYTHERIIQPPLGRVCGSSQAAGSRRAPLASGPEGVEELVGKPAFVMEPRQEMEKESTCVLMKPNTEIKLPVEVDIGLTQAEGPDETKNTEPQMGLVIEPPQCQFAQQHEQRKEAGNIESGVEPPDRIRPIYSGKFFDRTPCWPSAGKVIPVGYRVATCLTEKLPRLITPPEAKKYFNFRYPPAGVERVFYGRANDPQIAPYLTHGIRSKISVLANTLINPQPITTFQQKIKDKKESIYLSNRRAPLGKSHDQAPGLPKGMDTTNTTFGTAVIKEYSAKDVVNPPKSYEEVFKEGNEGHDLYVVSHNDYYAGEAKNRKYNPSSFHRCSVYGVPTPHFNDGRAMAKSLYWLHELQMKRGAKFVSKRADDFKEKFQHKLGRVLDPIAETMNVPPDCTFGACLRPEEYGVGDLIHNRLPDEYLRGKDRQRALIAAVRHHLKKVNYQKFDTLLAAFRHYDKKGDGMIDKDELQEACDQANLSLDDKLLDQLFDYCDVDNDGFINYLEFANFLNWKDKMLLKEYEERVIIKGRKPDCVNPTEANVEEPEQTLLIKPEDIVLKEAGSTEKTLRTLLRPSDKVSNYYKTTSSEINAIVGAIPSTCYPICGVPTIRSDIPAPRIRRISDRTNYGEEGSAYSLLYPTIFARKGVFERDFFKTRSKEEIAEILCNIGVKLSDEEFENVWNLASKKHHRGEVCVENIRNVLDELRHADRIKCKTLM

SEQ ID NO: 2011 - protein, 667 aa, Homo sapiens
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 2012 - protein, 202 aa, Homo sapiens
MELWGAYLLLCLFSLLTQVTTEPPTQKPKKIVNAKKDVVNTKMFEELKSRLDTLAQEVALLKEQQALQTVCLKGTKVHMKCFLAFTQTKTFHEASEDCISRGGTLGTPQTGSENDALYEYLRQSVGNEAEIWLGLNDMAAEGTWVDMTGARIAYKNWETEITAQPDGGKTENCAVLSGAANGKWFDKRCRDQLPYICQFGIV

SEQ ID NO: 2013 - protein, 612 aa, Homo sapiens
MLEGLGSPASPRAAASASVAGSSGPAACSPPSSSAPRSPESPAPRRGGVRASVPQKLAEMLSSQYGLIVFVAGLLLLLAWAVHAAGVSKSDLLCFLTALMLLQLLWMLWYVGRSSAHRRLFRLKDTHAGAGWLRGSITLFAVITVILGCLKIGYFIGFSECLSATEGVFPVTHSVHTLLQVYFLWGHAKDIIQSFKTLERFGVIHSVFTNLLLWANGVLNESKHQLNEHKERLITLGFGNITTVLDDHTPQCNCTPPTLCTAISHGIYYLYPFNIEYQILASTMLYVLWKNIGRKVDSHQHQKMQFKSDGVMVGAVLGLTVLAATIAVVVVYLIHIGRSKTKSESALIMFYLYAITLLMLMGAAGLAGIRIYRIDEKSLDESKNPARKLDSDLLVGTASGSWLISWGSILAILCAEGHPRYTWYNLPYSILAIVEKYIQNLFIFESIHREPEKLSEDIQTLRVVTVCNGNTMPLASSCPKSGGVARDVAPQGKDMPPAANGNVCMRESHDKEEEKQEESSWGGSPSPVRLPRFLQGNAKRKVLRNIAAFLFLCNISLWIPPAFGCRPEYDNGLEEIVFGFEPWIIVVNLAMPFSIFYRMHAAASLFEVYCKI

SEQ ID NO: 2014 - protein, 261 aa, Homo sapiens
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 2015 - protein, 2135 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 2016 - protein, 98 aa, Homo sapiens
MKLMVLVFTIGLTLLLGVQAMPANRLSCYRKILKDHNCHNLPEGVADLTQIDVNVQDHFWDGKGCEMICYCNFSELLCCPKDVFFGPKISFVIPCNNQ

SEQ ID NO: 2017 - protein, 480 aa, Homo sapiens
MKRSVAVWLLVGLSLGVPQFGKGDICDPNPCENGGICLPGLADGSFSCECPDGFTDPNCSSVVEVASDEEEPTSAGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 2018 - protein, 440 aa, Homo sapiens
MAVKLGTLLLALALGLAQPASARRKLLVFLLDGFRSDYISDEALESLPGFKEIVSRGVKVDYLTPDFPSLSYPNYYTLMTGRHCEVHQMIGNYMWDPTTNKSFDIGVNKDSLMPLWWNGSEPLWVTLTKAKRKVYMYYWPGCEVEILGVRPTYCLEYKNVPTDINFANAVSDALDSFKSGRADLAAIYHERIDVEGHHYGPASPQRKDALKAVDTVLKYMTKWIQERGLQDRLNVIIFSDHGMTDIFWMDKVIELNKYISLNDLQQVKDRGPVVSLWPAPGKHSEIYNKLSTVEHMTVYEKEAIPSRFYYKKGKFVSPLTLVADEGWFITENREMLPFWMNSTGRREGWQRGWHGYDNELMDMRGIFLAFGPDFKSNFRAAPIRSVDVYNVMCNVVGITPLPNNGSWSRVMCMLKGRASTAPPVWPSHCALALILLFLLA

SEQ ID NO: 2019 - protein, 116 aa, Homo sapiens
MESSRVRLLPLLGAALLLMLPLLGTRAQEDAELQPRALDIYSAVDDASHEKELIEALQEVLKKLKSKRVPIYEKKYGQVPMCDAGEQCAVRKGARIGKLCDCPRGTSCNSFLLKCL

SEQ ID NO: 2020 - protein, 454 aa, Homo sapiens
MARPNKFLLWFCCFAWLCFPISLGSQASGGEAQIAASAELESGAMPWSLLQHIDERDRAGLLPALFKVLSVGRGGSPRLQPDSRALHYMKKLYKTYATKEGIPKSNRSHLYNTVRLFTPCTRHKQAPGDQVTGILPSVELLFNLDRITTVEHLLKSVLLYNINNSVSFSSAVKCVCNLMIKEPKSSSRTLGRAPYSFTFNSQFEFGKKHKWIQIDVTSLLQPLVASNKRSIHMSINFTCMKDQLEHPSAQNGLFNMTLVSPSLILYLNDTSAQAYHSWYSLHYKRRPSQGPDQERSLSAYPVGEEAAEDGRSSHHRHRRGQETVSSELKKPLGPASFNLSEYFRQFLLPQNECELHDFRLSFSQLKWDNWIVAPHRYNPRYCKGDCPRAVGHRYGSPVHTMVQNIIYEKLDSSVPRPSCVPAKYSPLSVLTIEPDGSIAYKEYEDMIATKCTCR

SEQ ID NO: 2021 - protein, 77 aa, Homo sapiens
MWHLKLCAVLMIFLLLLGQIDGSPIPEVSSAKRRPRRMTPFWRGVSLRPIGASCRDDSECITRLCRKRRCSLSVAQE

SEQ ID NO: 2022 - protein, 303 aa, Homo sapiens
MSEPQPDLEPPQHGLYMLFLLVLVFFLMGLVGFMICHVLKKKGYRCRTSRGSEPDDAQLQPPEDDDMNEDTVERIVRCIIQNEANAEALKEMLGDSEGEGTVQLSSVDATSSLQDGAPSHHHTVHLGSAAPCLHCSRSKRPPLVRQGRSKEGKSRPRTGETTVFSVGRFRVTHIEKRYGLHEHRDGSPTDRSWGSGGGQDPGGGQGSGGGQPKAGMPAMERLPPERPQPQVLASPPVQNGGLRDSSLTPRALEGNPRASAEPTLRAGGRGPSPGLPTQEANGQPSKPDTSDHQVSLPQGAGSM

SEQ ID NO: 2023 - protein, 264 aa, Homo sapiens
MRTLWMALCALSRLWPGAQAGCAEAGRCCPGRDPACFARGWRLDRVYGTCFCDQACRFTGDCCFDYDRACPARPCFVGEWSPWSGCADQCKPTTRVRRRSVQQEPQNGGAPCPPLEERAGCLEYSTPQGQDCGHTYVPAFITTSAFNKERTRQATSPHWSTHTEDAGYCMEFKTESLTPHCALENWPLTRWMQYLREGYTVCVDCQPPAMNSVSLRCSGDGLDSDGNQTLHWQAIGNPRCQGTWKKVRRVDQCSCPAVHSFIFI

SEQ ID NO: 2024 - protein, 103 aa, Homo sapiens
MRQRLLPSVTSLLLVALLFPGSSQARHVNHSATEALGELRERAPGQGTNGFQLLRHAVKRDLLPPRTPPYQVHISHREARGPSFRICVDFLGPRWARGCSTGN

SEQ ID NO: 2025 - protein, 1288 aa, Homo sapiens
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSTKKQVILSSGTEFNAVKSLILGKVLEAAGADPDTRRAATSGFTGCLSAVRFGRAAPLKAALRPSGPSRVTVRGHVAPMARCAAGAASGSPARELAPRLAGGAGRSGPADEGEPLVNADRRDSAVIGGVIAVVIFILLCITAIAIRIYQQRKLRKENESKVSKKEEC

SEQ ID NO: 2026 - protein, 122 aa, Homo sapiens
MVPGPPESVVRFFLWFCFLLPPTRKASCDPRDLKSCNRPCVWSRLLKPNSSLSNLETAYFPQILRFLRPWYFSRSHLNYHQKAPARWEWLYSIYRKGTKAQRRNVLRSPCAPPQPSWPCSVI

SEQ ID NO: 2027 - protein, 628 aa, Homo sapiens
MAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLETPMNASSSHSCALETSPYVSTPMEATGAGPTRSAVGATSPTRMAQPAWGLSASHRAPAPPPPPLLLPLPLLLPLLELPLLHRSS

SEQ ID NO: 2028 - protein, 335 aa, Homo sapiens
MQGQGRRRGTCKDIFCSKMASYLYGVLFAVGLCAPIYCVSPANAPSAYPRPSSTKSTPASQVYSLNTDFAFRLYRRLVLETPSQNIFFSPARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 2029 - protein, 255 aa, Homo sapiens
MVLLLVILIPVLVSSAGTSAHYEMLGTCRMVCDPYGGTKAPSTAATPDRGLMQSLPTFIQGPKGEAGRPGKAGPRGPPGEPGPPGPMGPPGEKGEPGRQGLPGPPGAPGLNAAGAISAATYSTVPKIAFYAGLKRQHEGYEVLKFDDVVTNLGNHYDPTTGKFTCSIPGIYFFTYHVLMRGGDGTSMWADLCKNNQVRASAIAQDADQNYDYASNSVVLHLEPGDEVYIKLDGGKAHGGNNNKYSTFSGFIIYAD

SEQ ID NO: 2030 - protein, 538 aa, Homo sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPGVWVARPPRFRAQRLTELCYHLDANSKHGTKANRVYGPPSDRLPSAEAQLLPPELYNPNFQEEEDEGGDENAPGSPSFDQPHKTCCPDLNSFIEIKVEKDE

SEQ ID NO: 2031 - protein, 950 aa, Homo sapiens
MLLLGILTLAFAGRTAGGSEPEREVVVPIRLDPDINGRRYYWRGPEDSGDQGLIFQITAFQEDFYLHLTPDAQFLAPAFSTEHLGVPLQGLTGGSSDLRRCFYSGDVNAEPDSFAAVSLCGGLRGAFGYRGAEYVISPLPNASAPAAQRNSQGAHLLQRRGVPGGPSGDPTSRCGVASGWNPAILRALDPYKPRRAGFGESRSRRRSGRAKRFVSIPRYVETLVVADESMVKFHGADLEHYLLTLLATAARLYRHPSILNPINIVVVKVLLLRDRDSGPKVTGNAALTLRNFCAWQKKLNKVSDKHPEYWDTAILFTRQDLCGATTCDTLGMADVGTMCDPKRSCSVIEDDGLPSAFTTAHELGHVFNMPHDNVKVCEEVFGKLRANHMMSPTLIQIDRANPWSACSAAIITDFLDSGHGDCLLDQPSKPISLPEDLPGASYTLSQQCELAFGVGSKPCPYMQYCTKLWCTGKAKGQMVCQTRHFPWADGTSCGEGKLCLKGACVERHNLNKHRVDGSWAKWDPYGPCSRTCGGGVQLARRQCTNPTPANGGKYCEGVRVKYRSCNLEPCPSSASGKSFREEQCEAFNGYNHSTNRLTLAVAWVPKYSGVSPRDKCKLICRANGTGYFYVLAPKVVDGTLCSPDSTSVCVQGKCIKAGCDGNLGSKKRFDKCGVCGGDNKSCKKVTGLFTKPMHGYNFVVAIPAGASSIDIRQRGYKGLIGDDNYLALKNSQGKYLLNGHFVVSAVERDLVVKGSLLRYSGTGTAVESLQASRPILEPLTVEVLSVGKMTPPRVRYSFYLPKEPREDKSSHPKDPRGPSVLHNSVLSLSNQVEQPDDRPPARWVAGSWGPCSASCGSGLQKRAVDCRGSAGQRTVPACDAAHRPVETQACGEPCPTWELSAWSPCSKSCGRGFQRRSLKCVGHGGRLLARDQCNLHRKPQELDFCVLRPC

SEQ ID NO: 2032 - protein, 506 aa, Homo sapiens
MTSKPHSDWIPYSVLDDEGRNLRQQKLDRQRALLEQKQKKKRQEPLMVQANADGRPRSRRARQSEEQAPLVESYLSSSGSTSYQVQEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVREAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVSIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 2033 - protein, 197 aa, Homo sapiens
MAKNGLVICILVITLLLDQTTSHTSRLKARKHSKRRVRDKDGDLKTQIEKLWTEVNALKEIQALQTVCLRGTKVHKKCYLASEGLKHFHEANEDCISKGGILVIPRNSDEINALQDYGKRSLPGVNDFWLGINDMVTEGKFVDVNGIAISFLNWDRAQPNGGKRENCVLFSQSAQGKWSDEACRSSKRYICEFTIPQ

SEQ ID NO: 2034 - protein, 807 aa, Homo sapiens
KKKRKISLLPKPPKHDAPLTIEFPNLDKTSAEWLKVNGLKAKKLSLYQVLAPNAFSPVEEFVPILQKTVSSTIHEKAMIQFEWHDGTVKNIHVDPPFLYKYQQQLSRAMRMYERRIEWLSLASRRIWGTVCEKRVVVLLDISATNSMYIIHIQHSLRLLLEEQLSNKDCFNLIAFGSTIESWRPEMVPVSHNNLQSAWRWALNLRCRGSRNVLSALRKAVEVDFKDKDKHQSQGIYLFTGGIPDQDMPTLSAYMAEACGGCDLQLNVCLFYVGEPKMDTTPPARYASHTDTAAAYKEVTRAAGGRFHWFGDTGIYESDDINSIMSEMEKALNYSQKCAFLMASLKNHSGKVLGSSALPKEKPKTLQLRSQPKKLCPPRPTVPLGARMSIKDDPDREKSPPLKSLKWRPLSSRVGISPAAAQPTKEGMMELRRKTKSREAETSLLLFYTEKGNDVGSVYKKYPQGRGLRRTSSSIDLPRKDTVCSSQEWVAKYGLKKLKLEISRCMGPNCTHQKSGQRSASAKHCSIFPSVEIHGVVRHIQWTPREMEVYIRHLEKVLRRYVQRLQWLLSGSRRLFGTVLESKVCILLDTSGSMGPYLQQVKTELVLLIWEQLRKCCDSFNLLSFAESFQSWQDTLVETTDAACHEAMQWVTHLQAQGSTSILQALLKAFSFHDLEGLYLLTDGKPDTSCSLVLNEVQKLREKRDVKVHTISLNCSDRAAVEFLRKLASFTGGRYHCPVGEDTLSKIHSLLTKGFINEKDPTLPPFEGDDLRILAQEITKARSFLWQAQSFRSQLQKKNDAEPKVTLS

SEQ ID NO: 2035 - protein, 212 aa, Homo sapiens
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWNKKLLYEKMKGGERRKRRSVNPYLQGQRLDNVVAKKSVPHFSDEDKDPE

SEQ ID NO: 2036 - protein, 507 aa, Homo sapiens
MCTKTIPVLWGCFLLWNLYVSSSQTIYPGIKARITQRALDYGVQAGMKMIEQMLKEKKLPDLSGSESLEFLKVDYVNYNFSNIKISAFSFPNTSLAFVPGVGIKALTNHGTANISTDWGFESPLFQDTGGADLFLSGVYFTGIIILTRNDFGHPTLKLQDCYAQLSHAHVSFSGELSVLYNSFAEPMEKPILKNLNEMLCPIIASEVKALNANLSTLEVLTKIDNYTLLDYSLISSPEITENYLDLNLKGVFYPLENLTDPPFSPVPFVLPERSNSMLYIGIAEYFFKSASFAHFTAGVFNVTLSTEEISNHFVQNSQGLGNVLSRIAEIYILSQPFMVRIMATEPPIINLQPGNFTLDIPASIMMLTQPKNSTVETIVSMDFVASTSVGLVILGQRLVCSLSLNRFRLALPESNRSNIEVLRFENILSSILHFGVLPLANAKLQQGFPLSNPHKFLFVNSDIEVLEGFLLISTDLKYETSSKQQPSFHVWEGLNLISRQWRGKSAP

SEQ ID NO: 2037 - protein, 157 aa, Homo sapiens
MHPWLGSALGFPKCRGIHLCACGNGWTPGETLSQNKTEITKNKVTCWRPHGCEPNTGLGYQGSHTSKYTLLPWNLLKTKPLPPSHGKEGGKEAKVPSGDNSGRGEVPRAQEGQAACGRAASGDSQEGMRRGYEERATAQRPAVRSAETTAHGTWIYP

SEQ ID NO: 2038 - protein, 70 aa, Homo sapiens
MSNNMAKIAEARKTVEQLKLEVNIDRMKVSQAAAELLAFCETHAKDDPLVTPVPAAENPFRDKRLFCVLL

SEQ ID NO: 2039 - protein, 214 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMSLVSPALRCLEPPHLANLTLEDAAECLKQH

SEQ ID NO: 2040 - protein, 152 aa, Homo sapiens
MSPHLTALLGLVLCLAQTIHTQEGALPRPSISAEPGTVISPGSHVTFMCRGPVGVQTFRLEREDRAKYKDSYNVFRLGPSESEARFHIDSVSEGNAGLYRCLYYKPPGWSEHSDFLELLVKESSGGPDSPDTEPGSSAGTVPGTEASGFDAP

SEQ ID NO: 2041 - protein, 299 aa, Homo sapiens
MAPWSHPSAQLQPVGGDAVSPALMVLLCLGLSLGPRTHVQAGNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGAADNLSPSQNKSDSGTASHLQDYAVENLIRMGMAGLILVVLGILIFQDWHSQRSPQAAAGR

SEQ ID NO: 2042 - protein, 205 aa, Homo sapiens
MKVLLLTGLGALFFAYYWDDNFDPGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 2043 - protein, 264 aa, Homo sapiens
MLRCGGRGLLLGLAVAAAAVMAARLMGWWGPRAGFRLFIPEELSRYRGGPGDPGLYLALLGRVYDVSSGRRHYEPGSHYSGFAGRDASRAFVTGDCSEAGLVDDVSDLSAAEMLTLHNWLSFYEKNYVCVGRVTGRFYGEDGLPTPALTQVEAAITRGLEANKLQLQEKQTFPPCNAEWSSARGSRLWCSQKSGGVSRDWIGVPRKLYKPGAKEPRCVCVRTTGPPSGQMPDNPPHRNRGDLDHPNLAEYTGCPPLAITCSFPL

SEQ ID NO: 2044 - protein, 155 aa, Homo sapiens
MSKRLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGP

SEQ ID NO: 2045 - protein, 165 aa, Homo sapiens
MEMFQGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 2046 - protein, 329 aa, Homo sapiens
MLPLLLGLLGPAACWALGPTPGPGSSELRSAFSAARTTPLEGTSEMAVTFDKVYVNIGGDFDVATGQFRCRVPGAYFFSFTAGKAPHKSLSVMLVRNRDEVQALAFDEQRRPGARRAASQSAMLQLDYGDTVWLRLHGAPQYALGAPGATFSGYLVYADADADAPARGPPAPPEPRSAFSAARTRSLVGSDAGPGPRHQPLAFDTEFVNIGGDFDAAAGVFRCRLPGAYFFSFTLGKLPRKTLSVKLMKNRDEVQAMIYDDGASRRREMQSQSVMLALRRGDAVWLLSHDHDGYGAYSNHGKYITFSGFLVYPDLAPAAPPGLGASELL

SEQ ID NO: 2047 - protein, 290 aa, Homo sapiens
MRRPAAVPLLLLLCFGSQRAKAATACGRPRMLNRMVGGQDTQEGEWPWQVSIQRNGSHFCGGSLIAEQWVLTAAHCFRNTSETSLYQVLLGARQLVQPGPHAMYARVRQVESNPLYQGTASSADVALVELEAPVPFTNYILPVCLPDPSVIFETGMNCWVTGWGSPSEEDLLPEPRILQKLAVPIIDTPKCNLLYSKDTEFGYQPKTIKNDMLCAGFEEGKKDACKGDSGGPLVCLVGQSWLQAGVISWGEGCARQNRPGVYIRVTAHHNWIHRIIPKLQFQPARLGGQK

SEQ ID NO: 2048 - protein, 263 aa, Homo sapiens
MAFLWLLSCWALLGTTFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSRTCSTTTPAVYARVAKLIPWVQKILAAN

SEQ ID NO: 2049 - protein, 75 aa, Homo sapiens
MGAAISQGALIAIVCNGLVGFLLLLLWVILCWACHSRSADVDSLSESRTQESACLELDPAAQSLASLAPIGAQWP

SEQ ID NO: 2050 - protein, 253 aa, Homo sapiens
MARSLLLPLQILLLSLALETAGEEAQGDKIIDGAPCARGSHPWQVALLSGNQLHCGGVLVNERWVLTAAHCKMNEYTVHLGSDTLGDRRAQRIKASKSFRHPGYSTQTHVNDLMLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 2051 - protein, 159 aa, Homo sapiens
MKAWGTVVVTLATLMVVTVDAKIYERCELAARLERAGLNGYKGYGVGDWLCMAHYESGFDTAFVDHNPDGSSEYGIFQLNSAWWCDNGITPTKNLCHMDCHDLLNRHILDDIRCAKQIVSSQNGLSAWTSWRLHCSGHDLSEWLKGCDMHVKIDPKIHP

SEQ ID NO: 2052 - protein, 166 aa, Homo sapiens
MAQTNSFFMLISSLMFLSLSQGQESQTELPNPRISCPEGTNAYRSYCYYFNEDPETWVDADLYCQNMNSGNLVSVLTQAEGAFVASLIKESSTDDSNVWIGLHDPKKNRRWHWSSGSLVSYKSWDTGSPSSANAGYCASLTSCSGFKKWKDESCEKKFSFVCKFKN

SEQ ID NO: 2053 - protein, 175 aa, Homo sapiens
MLPPMALPSVSWMLLSCLMLLSQVQGEEPQRELPSARIRCPKGSKAYGSHCYALFLSPKSWTDADLACQKRPSGNLVSVLSGAEGSFVSSLVKSIGNSYSYVWIGLHDPTQGTEPNGEGWEWSSSDVMNYFAWERNPSTISSPGHCASLSRSTAFLRWKDYNCNVRLPYVCKFTD

SEQ ID NO: 2054 - protein, 561 aa, Homo sapiens
MGARTPLPSFWVSFFAETGILFPGGTPWPMGSQHSKQHRKPGPLKRGHRRDRRTTRRKYWKEGREIARVLDDEGRNLRQQKLDRQRALLEQKQKKKRQEPLMVQANADGRPRSRRARQSEEQAPLVESYLSSSGSTSYQVQEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVREAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVSIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 2055 - protein, 423 aa, Homo sapiens
MMYRPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFSQQKHGVLAHMLLICRFHSTEDPETVDKIVQLVLHEKLQDAVGPPKVDPHSVKIKKINKTETDSYLNHCCGTRRSKTLGQSLRIVGGTEVEEGEWPWQASLQWDGSHRCGATLINATWLVSAAHCFTTYKNPARWTASFGVTIKPSKMKRGLRRIIVHEKYKHPSHDYDISLAELSSPVPYTNAVHRVCLPDASYEFQPGDVMFVTGFGALKNDGYSQNHLRQAQVTLIDATTCNEPQAYNDAITPRMLCAGSLEGKTDACQGDSGGPLVSSDARDIWYLAGIVSWGDECAKPNKPGVYTRVTALRDWITSKTGI

SEQ ID NO: 2056 - protein, 93 aa, Homo sapiens
MKPVLPLQFLVVFCLALQLVPGSPKQRVLKYILEPPPCISAPENCTHLCTMQEDCEKGFQCCSSFCGIVCSSETFQKRNRIKHKGSEVIMPAN

SEQ ID NO: 2057 - protein, 509 aa, Homo sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSESQR

SEQ ID NO: 2058 - protein, 126 aa, Homo sapiens
MDKSLLLELPILLCCFRALSGSLSMRNDAVNEIVAVKNNFPVIEIVQCRMCHLQFPGEKCSRGRGICTATTEEACMVGRMFKRDGNPWLTFMGCLKNCADVKGIRWSVYLVNFRCCRSHDLCNEDL

SEQ ID NO: 2059 - protein, 178 aa, Homo sapiens
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGTPENGNDQPQSDKESVKLLTVKTISHESGEHSAQGKTKN

SEQ ID NO: 2060 - protein, 847 aa, Homo sapiens
MFKCWSVVLVLGFIFLESEGRPTKEGGYGLKSYQPLMRLRHKQEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTLANILWREEGLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 2061 - protein, 90 aa, Homo sapiens
MRLSVCLLLLTLALCCYRANAVVCQALGSEITGFLLAGKPVFKFQLAKFKAPLEAVAAKMEVKKCVDTMAYEKRVLITKTLGKIAEKCDR

SEQ ID NO: 2062 - protein, 347 aa, Homo sapiens
MSSWSRQRPKSPGGIQPHVSRTLFLLLLLAASAWGVTLSPKDCQVFRSDHGSSISCQPPAEIPGYLPADTVHLAVEFFNLTHLPANLLQGASKLQELHLSSNGLESLSPEFLRPVPQLRVLDLTRNALTGLPPGLFQASATLDTLVLKENQLEVLEVSWLHGLKALGHLDLSGNRLRKLPPGLLANFTLLRTLDLGENQLETLPPDLLRGPLQLERLHLEGNKLQVLGKDLLLPQPDLRYLFLNGNKLARVAAGAFQGLRQLDMLDLSNNSLASVPEGLWASLGQPNWDMRDGFDISGNPWICDQNLSDLYRWLQAQKDKMFSQNDTRCAGPEAVKGQTLLAVAKSQ

SEQ ID NO: 2063 - protein, 468 aa, Homo sapiens
MPPWGAALALILAVLALLGLLGPRLRGPWGRAVGERTLPGAQDRDDGEEADGGGPADQFSDGREPLPGGCSLVCKPSALAQCLLRALRRSEALEAGPRSWFSGPHLQTLCHFVLPVAPGPELAREYLQLADDGLVALDWVVGPCVRGRRITSAGGLPAVLLVIPNAWGRLTRNVLGLCLLALERGYYPVIFHRRGHHGCPLVSPRLQPFGDPSDLKEAVTYIRFRHPAAPLFAVSEGSGSALLLSYLGECGSSSYVTGAACISPVLRCREWFEAGLPWPYERGFLLHQKIALSRYATALEDTVDTSRLFRSRSLREFEEALFCHTKSFPISWDTYWDRNDPLRDVDEAAVPVLCICSADDPVCGPPDHTLTTELFHSNPYFFLLLSRHGGHCGFLRQEPLPAWSHEVILESFRALTEFFRTEERIKGLSRHRASFLGGRRRGGALQRREVSSSSNLEEIFNWKRSYTR

SEQ ID NO: 2064 - protein, 140 aa, Homo sapiens
MFFTISRKNMSQKLSLLLLVFGLIWGLMLLHYTFQQPRHQSSVKLREQILDLSKRYVKALAEENKNTVDVENGASMAGYADLKRTIAVLLDDILQRLVKLENKVDYIVVNGSAANTTNGTSGNLVPVTTNKRTNVSGSIR

SEQ ID NO: 2065 - protein, 330 aa, Homo sapiens
RGALVGAPRSARASCLRGRRPGRRQPCGRCPDPPRSGPGQAGRARCARDVAAQTALAPRALALGAGAAGPGWRGAVPRRPAARVSRAAQRQEQELVRLHREQECELQPEPAPPRPSGPATAEDPGRRPVLPQRPPEERPPQPPGSTGVIAETGQAGPPAGAGVSGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 2066 - protein, 194 aa, Homo sapiens
MSALWLLLGLLALMDLSESSNWGCYGNIQSLDTPGASCGIGRRHGLNYCGVRASERLAEIDMPYLLKYQPMMQTIGQKYCMDPAVIAGVLSRKSPGDKILVNMGDRTSMVQDPGSQAPTSWISESQVSQTTEVLTTRIKEIQRRFPTWTPDQYLRGGLCAYSGGAGYVRSSQDLSCDFCNDVLARAKYLKRHGF

SEQ ID NO: 2067 - protein, 90 aa, Homo sapiens
MKFLAVLVLLGVSIFLVSAQNPTTAAPADTYPATGPADDEAPDAETTAAATTATTAAPTTATTAASTTARKDIPVLPKWVGDLPNGRVCP

SEQ ID NO: 2068 - protein, 637 aa, Homo sapiens
MSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVAQVAFLGGYSSAASRISEPLSRASYLSLGLGLCLQLYAL

SEQ ID NO: 2069 - protein, 199 aa, Homo sapiens
MALNGAEVDDFSWEPPTEAETKVLQARRERQDRISRLMGDYLLRGYRMLGETCADCGTILLQDKQRKIYCVACQELDSDVDKDNPALNAQAALSQAREHQLASASELPLGSRPAPQPPVPRPEHCEGAAAGLKAAQGPPAPAVPPNTDVMACTQTALLQKLTWASAELGSSTSLETSIQLCGLIRACAEALRSLQQLQH

SEQ ID NO: 2070 - protein, 270 aa, Homo sapiens
MKLGCVLMAWALYLSLGVLWVAQMLLAASFETLQCEGPVCTEESSCHTEDDLTDAREAGFQVKAYTFSEPFHLIVSYELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 2071 - protein, 806 aa, Homo sapiens
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCCGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 2072 - protein, 1413 aa, Homo sapiens
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSQPTASAQLENMEEAPKRVSLALQLPEHGSKDIGNVPGNCSENPCQNGGTCVPGADAHSCDCGPGFKGRRCELACIKVSRPCTRLFSETKAFPVWEGGVCHHVYKRVYRVHQDICFKESCESTSLKKTPNRKQSKSQTLEKS

SEQ ID NO: 2073 - protein, 335 aa, Homo sapiens
MFLATLSFLLPFAHPFGTVSCEYMLGSPLSSLAQVNLSPFSHPKVHMDPNYCHPSTSLHLCSLAWSFTRLLHPPLSPGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 2074 - protein, 275 aa, Homo sapiens
MQPPGPRDPLIRLCFFREEGTNVVQKICFSTQIIRHFESKLSDTIEVYQERIQWLTENSKKAFGLIKGARVSILIDVSAISSGPQKEEFQKDLMSLIDEQLSHKEKLFVLSFGTNAGSLWPDPMEVSASTLQELKLWVKTLQPDGGSNLLQALKKIFTLKGLDSLVAIMRSCPDQPSEILSDYIQQSTMGRDLIIHFITYRCDDQMPPAVLKNLAEAVRGYYHCYSPKMEHYTSRDMDELLAEIQKAQSLLSHVQALQHSSPCEALTCTMEEPRN

SEQ ID NO: 2075 - protein, 145 aa, Homo sapiens
MLTRLVLSAHLSSTTSPPWTHAAISWELDNVLMPSPRIWPQVTPTGRSASVRSEGNTSSLWNFSAGQDVHAIVTRTCESVLSSAVYTHGCGCVRSATNITCQSSGQQRQAARQEEENSICKAHDSREGRLGYPLSAHQPGSGGPN

SEQ ID NO: 2076 - protein, 258 aa, Homo sapiens
MTPPKLRASLSPSLLLLLSGCLLAAARREKGAASNVAEPVPGPTGGSSGRFLSPEQHACSWQLLLPAPEAAAGSELALRCQSPDGARHQCAYRGHPERCAAYAARRAHFWKQVLGGLRKKRRPCHDPAPLQARLCAGKKGHGAELRLVPRASPPARPTVAGFAGESKPRARNRGRTRERASGPAAGTPPPQSAPPKENPSERKTNEGKRKAALVPNEERPMGTGPDPDGLDGNAELTETYCAEKWHSLCNFFVNFWNG

SEQ ID NO: 2077 - protein, 130 aa, Homo sapiens
MARRHCFSYWLLVCWLVVTVAEGQEEVFTPPGDSQNNADATDCQIFTLTPPPAPRSPVTRAQPITKTPRCPFHFFPRRPRIHFRFPNRPFVPSRCNHRFPFQPFYWPHRYLTYRYFPRRRLQRGSSSEES

SEQ ID NO: 2078 - protein, 199 aa, Homo sapiens
MYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 2079 - protein, 233 aa, Homo sapiens
MALKNKFSCLWILGLCLVATTSSKIPSITDPHFIDNCIEAHNEWRGKVNPPAADMKYMIWDKGLAKMAKAWANQCKFEHNDCLDKSYKCYAAFEYVGENIWLGGIKSFTPRHAITAWYNETQFYDFDSLSCSRVCGHYTQLVWANSFYVGCAVAMCPNLGGASTAIFVCNYGPAGNFANMPPYVRGESCSLCSKEEKCVKNLCKNPFLKPTGRAPQQTAFNPFSLGFLLLRIF

SEQ ID NO: 2080 - protein, 222 aa, Homo sapiens
MALHIHEACILLLVIPGLVTSAAISHEDYPADEGDQISSNDNLIFDDYRGKGCVDDSGFVYKLGERFFPGHSNCPCVCALDGPVCDQPECPKIHPKCTKVEHNGCCPECKEVKNFCEYHGKNYKILEEFKPSPCEWCRCEPSNEVHCVVADCAVPECVNPVYEPEQCCPVCKNGPNCFAGTTIIPAGIEVKVDECNICHCHNGDWWKPAQCSKRECQGKQTV

SEQ ID NO: 2081 - protein, 318 aa, Homo sapiens
MLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPVILIVDKVLETQDLNGDGLMTPAELINFPGVALRHVEPGEPLAPSPQEPQAVGRQSLLAKSPLRQETQEAPGPREEAKGQVEARRESLDPVQEPGGQAEADGDVPGPRGEAEGQAEAKGDAPGPRGEAGGQAEAEGDAPGPRGEAGGQAEAEGDAPGPRGEAGGQAEARENGEEAKELPGETLESKNTQNDFEVHIVQVENDEI

SEQ ID NO: 2082 - protein, 130 aa, Homo sapiens
MLAPLFLCCLRNLFRKLISFQPPQLGRTNMHYSKLPRTAIETEFKQNVGPPPKDLTAEVYFPSIKSRSHLPAVFYNQYFKHPKCVGEYGPKNGAERQIEERKVLPTTMMFSMLADCVLKSTPIPILGVAM

SEQ ID NO: 2083 - protein, 1453 aa, Homo sapiens
MMLPQNSWHIDFGRCCCHQNLFSAVVTCILLLNSCFLISSFNGTDLELRLVNGDGPCSGTVEVKFQGQWGTVCDDGWNTTASTVVCKQLGCPFSFAMFRFGQAVTRHGKIWLDDVSCYGNESALWECQHREWGSHNCYHGEDVGVNCYGEANLGLRLVDGNNSCSGRVEVKFQERWGTICDDGWNLNTAAVVCRQLGCPSSFISSGVVNSPAVLRPIWLDDILCQGNELALWNCRHRGWGNHDCSHNEDVTLTCYDSSDLELRLVGGTNRCMGRVELKIQGRWGTVCHHKWNNAAADVVCKQLGCGTALHFAGLPHLQSGSDVVWLDGVSCSGNESFLWDCRHSGTVNFDCLHQNDVSVICSDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSDKADLDLRLVGAHSPCYGRLEVKYQGEWGTVCHDRWSTRNAAVVCKQLGCGKPLHVFGMTYFKEASGPIWLDDVSCIGNESNIWDCEHSGWGKHNCVHREDVIVTCSGDATWGLRLVGGSNRCSGRLEVYFQGRWGTVCDDGWNSKAAAVVCSQLDCPSSIIGMGLGNASTGYGKIWLDDVSCDGDESDLWSCRNSGWGNNDCSHSEDVGVICSDASDMELRLVGGSSRCAGKVEVNVQGAVGILCANGWGMNIAEVVCRQLECGSAIRVSREPHFTERTLHILMSNSGCTGGEASLWDCIRWEWKQTACHLNMEASLICSAHRQPRLVGADMPCSGRVEVKHADTWRSVCDSDFSLHAANVLCRELNCGDAISLSVGDHFGKGNGLTWAEKFQCEGSETHLALCPIVQHPEDTCIHSREVGVVCSRYTDVRLVNGKSQCDGQVEINVLGHWGSLCDTHWDPEDARVLCRQLSCGTALSTTGGKYIGERSVRVWGHRFHCLGNESLLDNCQMTVLGAPPCIHGNTVSVICTGSLTQPLFPCLANVSDPYLSAVPEGSALICLEDKRLRLVDGDSRCAGRVEIYHDGFWGTICDDGWDLSDAHVVCQKLGCGVAFNATVSAHFGEGSGPIWLDDLNCTGMESHLWQCPSRGWGQHDCRHKEDAGVICSEFTALRLYSETETESCAGRLEVFYNGTWGSVGRRNITTAIAGIVCRQLGCGENGVVSLAPLSKTGSGFMWVDDIQCPKTHISIWQCLSAPWERRISSPAEETWITCEDRIRVRGGDTECSGRVEIWHAGSWGTVCDDSWDLAEAEVVCQQLGCGSALAALRDASFGQGTGTIWLDDMRCKGNESFLWDCHAKPWGQSDCGHKEDAGVRCSGQSLKSLNASSGHLALILSSIFGLLLLVLFILFLTWCRVQKQKHLPLRVSTRRRGSLEENLFHEMETCLKREDPHGTRTSDDTPNHGCEDASDTSLLGVLPASEATK

SEQ ID NO: 2084 - protein, 252 aa, Homo sapiens
MLPPPRPAAALALPVLLLLLVVLTPPPTGARPSPGPDYLRRGWMRLLAEGEGCAPCRPEECAAPRGCLAGRVRDACGCCWECANLEGQLCDLDPSAHFYGHCGEQLECRLDTGGDLSRGEVPEPLCACRSQSPLCGSDGHTYSQICRLQEAARARPDANLTVAHPGPCESGPQIVSHPYDTWRGPRLQTLGTEDTLTTLVGAGGMARAVACGEAPGEHLALQVLCLSGKRRHLWQVGSTGSSEGVPSGGSFW

SEQ ID NO: 2085 - protein, 440 aa, Homo sapiens
MKLALLLPWACCCLCGSALATGFLYPFSAAALQQHGYPEPGAGSPGSGYASRRHWCHHTVTRTVSCQVQNGSETVVQRVYQSCRWPGPCANLVSYRTLIRPTYRVSYRTVTVLEWRCCPGFTGSNCDEECMNCTRLSDMSERLTTLEAKVLLLEAAERPSSPDNDLPAPESTPPTWNEDFLPDAIPLAHPVPRQRRPTGPAGPPGQTGPPGPAGPPGSKGDRGQTGEKGPAGPPGLLGPPGPRGLPGEMGRPGPPGPPGPAGNPGPSPNSPQGALYSLQPPTDKDNGDSRLASAIVDTVLAGVPGPRGPPGPPGPPGPRGPPGPPGTPGSQGLAGERGTVGPSGEPGVKGEEGEKAATAEGEGVQQLREALKILAERVLILEHMIGIHDPLASPEGSGQDAALRANLKMKRGGAQPDGVLAALLGPDPGQKSVDQASSRK

SEQ ID NO: 2086 - protein, 446 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNNQRCKTRNRYICQFAQEHISRWGPGS

SEQ ID NO: 2087 - protein, 72 aa, Homo sapiens
MQRLVLLLAISLLLYQDLPVRSEFELDRICGYGTARCRKKCRSQEYRIGRCPNTYACCLRKWDESLLNRTKP

SEQ ID NO: 2088 - protein, 782 aa, Homo sapiens [sequence omitted]

SEQ ID NO: 2089 - protein, 136 aa, Homo sapiens
MSNVPHKSSLPEGIRPGTVLRIRGLVPPNASRFHVNLLCGEEQGSDAALHFNPRLDTSEVVFNSKEQGSWGREERGPGVPFQRGQPFEVLIIASDDGFKAVVGDAQYHHFRHRLPLARVRLVEVGGDVQLDSVRIF

SEQ ID NO: 2090 - protein, 641 aa, Homo sapiens
MPPPLPLLLLTVLVVAAARPGCEFERNPAATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYILWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 2091 - protein, 434 aa, Homo sapiens
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENNVTGHPVFYLPLCDSFLPPKAAPVTELYTDGPVMFCGMGGFSDFYKLRWLEAILSWQKQQEGCFGEPDAEDEELSKAIQYQQHFSRRVKRREKQFPDSRSVAQAGVQWRNLGSLQPLPPGFKQFSCLILPSSWDYRSVPPYLANFYIFLVETGFHHVAHAGLELLISRDPPTSGSQSVGL

SEQ ID NO: 2092 - protein, 184 aa, Homo sapiens
MMSFLLGAILTLLWAPTAQAEVLLQPDFNAEKFSGLWYVVSMASDCRVFLGKKDHLSMSTRAIRPTEEGGLHVHMEFPGADGCNQVDAEYLKVGSEGHFRVPALGYLDVRIVDTDYSSFAVLYIYKELEGALSTMVQLYSRTQDVSPQALKSFQDFYPTLGLPKDMMVMLPQSDACNPESKEAP

SEQ ID NO: 2093 - protein, 72 aa, Homo sapiens; identical to SEQ ID NO: 2087

SEQ ID NO: 2094 - protein, 748 aa, Homo sapiens
MGRAGAAAVIPGLALLWAVGLGSAAPPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 2095 - protein, 122 aa, Homo sapiens
MVLLCLFLASLAATPRAGVTGAWPTSGLSILAQLQPSCELRWTQLSRSSWRDLVMTTSLWSLAYFQHFSQETTTQEQLDEMEEIPRESQCGRQDFHALSCPTASPRDRVLLCCPGWRAMVPS

SEQ ID NO: 2096 - protein, 189 aa, Homo sapiens
MLLGQLSTLLCLLSGALPTGSGRPEPQSPRPQSWAAANQTWALGPGALPPLVPASALGSWKAFLGLQKARQLGMGRLQRGQDEVAAVTLPLNPQEVIQGMCKAVPFVQVFSRPGCSAIRLRNHLCFGHCSSLYIPGSDPTPLVLCNSCMPARKRWAPVVLWCLTGSSASRRRVKISTMLIEGCHCSPKA

SEQ ID NO: 2097 - protein, 834 aa, Homo sapiens
MKHTLALLAPLLGLGLGLALSQLAAGATDCKFLGPAEHLTFTPAARARWLAPRVRAPGLLDSLYGTVRRFLSVVQLNPFPSELVKALLNELASVKVNEVVRYEAGYVVCAVIAGLYLLLVPTAGLCFCCCRCHRRCGGRVKTEHKALACERAALMVFLLLTTLLLLIGVVCAFVTNQRTHEQMGPSIEAMPETLLSLWGLVSDVPQELQAVAQQFSLPQEQVSEELDGVGVSIGSAIHTQLRSSVYPLLAAVGSLGQVLQVSVHHLQTLNATVVELQAGQQDLEPAIREHRDRLLELLQEARCQGDCAGALSWARTLELGADFSQVPSVDHVLHQLKGVPEANFSSMVQEENSTFNALPALAAMQTSSVVQELKKAVAQQPEGVRTLAEGFPGLEAASRWAQALQEVEESSRPYLQEVQRYETYRWIVGCVLCSVVLFVVLCNLLGLNLGIWGLSARDDPSHPEAKGEAGARFLMAGVGLSFLFAAPLILLVFATFLVGGNVQTLVCQSWENGELFEFADTPGNLPPSMNLSQLLGLRKNISIHQAYQQCKEGAALWTVLQLNDSYDLEEHLDINQYTNKLRQELQSLKVDTQSLDLLSSAARRDLEALQSSGLQRIHYPDFLVQIQRPVVKTSMEQLAQELQGLAQAQDNSVLGQRLQEEAQGLRNLHQEKVVPQQSLVAKLNLSVRALESSAPNLQLETSDVLANVTYLKGELPAWAARILRNVSECFLAREMGYFSQYVAWVREEVTQRIATCQPLSGALDNSRVILCDMMADPWNAFWFCLAWCTFFLIPSIIFAVKTSKYFRPIRKRLSSTSSEETQLFHIPRVTSLKL

SEQ ID NO: 2098 - protein, 834 aa, Homo sapiens; identical to SEQ ID NO: 2097

SEQ ID NO: 2099 - protein, 71 aa, Homo sapiens
MTQLLLFLVALLVLGHVPSGRSEFKRCWKGQGACQTYCTRQETYMHLCPDASLCCLSYALKPPPVPKHEYE

SEQ ID NO: 2100 - protein, 458 aa, Homo sapiens
MEATGTDEVDKLKTKFISAWNNMKYSWVLKTKTYFSRNSPVLLLGKCYHFKYEDEDKTLPAESGCTIEDHVIAGNVEEFRKDFISRIWLTYREEFPQIEGSALTTDCGWGCTLRTGQMLLAQGLILHFLGRAWTWPDALNIENSDSESWTSHTVKKFTASFEASLSGEREFKTPTISLKETIGKYSDDHEMRNEVYHRKIISWFGDSPLALFGLHQLIEYGKKSGKKAGDWYGPAVVAHILRKAVEEARHPDLQGITIYVAQDCTVYNSDVIDKQSASMTSDNADDKAVIILVPVRLGGERTNTDYLEFVKGILSLEYCVGIIGGKPKQSYYFAGFQDDSLIYMDPHYCQSFVDVSIKDFPLETFHCPSPKKMSFRKMDPSCTIGFYCRNVQDFKRASEEITKMLKFSSKEKYPLFTFVNGHSRDYDFTSTTTNEEDLFSEDEKKQLKRFSTEEFVLL

SEQ ID NO: 2101 - protein, 113 aa, Homo sapiens
MRQRLLPSVTSLLLVALLFPGSSQARHVNHSATEALGELRERAPGQGTNGFQLLRHAVKRDLLPPRTPPYQEPASDLKVVDCRRSEGFCQEYCNYMETQVGYCSKKKDACCLH

SEQ ID NO: 2102 - protein, 85 aa, Homo sapiens
MKKVLLLITAILAVAVGFPVSQDQEREKRSISDSDELASGFFVFPYPYPFRPLPPIPFPRFPWFRRNFPIPIPESAPTTPLPSEK

SEQ ID NO: 2103 - protein, 87 aa, Homo sapiens
MAVSVLRLTVVLGLLVLFLTCYADDKPDKPDDKPDDSGKDPKPDFPKFLSLLGTEIIENAVEFILRSMSRSTGFMEFDDNEGKHSSK

SEQ ID NO: 2104 - protein, 314 aa, Homo sapiens
MSSEAETQQPPAAPPAAPALSAADTKPGTTGAQGAVARAHIGGAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPERPNNAGPQAKVPTLLHAEYGRRPQYSNPPVQGEVMEGADNQGAGEQGRPVRQCIGDIDHDSAGALLARQPREDGNEEDKENQGDETQGQQPPQRRYRRNFNYRRRRPENPKPQDGKETKAADPPAENSSAPEAEQGGAE

SEQ ID NO: 2105 - protein, 211 aa, Homo sapiens
MVFLKFFCMSFFCHLCQGYFDGPLYPEMSNGTLHHYFVPDGDYEENDDPEKCQLLFRVSDHRRCSQGEGSQVGSLLSLTLREEFTVLGRQVEDAGRVLEGISKSISYDLDGEESYGKYLRRESHQIGDAYSNSDKSLTELESKFKQGQEQDSRQESRLNEDFLGMLVHTRSLLKETLDISVGLRDKYELLALTIRSHGTRLGRLKNDYLKV

SEQ ID NO: 2106 - protein, 521 aa, Homo sapiens
MLCALLLLPSLLGATRASPTSGPQECAKGSTVWCQDLQTAARCGAVGYCQGAVWNKPTAKSLPCDVCQDIAAAAGNGLNPDATESDILALVMKTCEWLPSQESSAGCKWMVDAHSSAILSMLRGAPDSAPAQVCTALSLCEPLQRHLATLRPLSKEDTFEAVAPFMANGPLTFHPRQAPEGALCQDCVRQVSRLQEAVRSNLTLADLNIQEQCESLGPGLAVLCKNYLFQFFVPADQALRLLPPQELCRKGGFCEELGAPARLTQVVAMDGVPSLELGLPRKQSEMQMKAGVTCEVCMNVVQKLDHWLMSNSSELMITHALERVCSVMPASITKECIILVDTYSPSLVQLVAKITPEKVCKFIRLCGNRRRARAVHDAYAIVPSPEWDAENQGSFCNGCKRLLTVSSHNLESKSTKRDILVAFKGGCSILPLPYMIQCKHFVTQYEPVLIESLKDMMDPVAVCKKVGACHGPRTPLLGTDQCALGPSFWCRSQEAAKLCNAVQHCQKHVWKEMHLHAGEHA

SEQ ID NO: 2107 - protein, 708 aa, Homo sapiens
MAAAAVAAAAAAAAAASLQVLEMESMETAAAGSAGLAAEVRGSGTVDFGPGPGISAMEASGGDPGPEAEDFECSSHCSELSWRQNEQRRQGLFCDITLCFGGAGGREFRAHRSVLAAATEYFTPLLSGQFSESRSGRVEMRKWSSEPGPEPDTVEAVIEYMYTGRIRVSTGSVHEVLELADRFLLIRLKEFCGEFLKKKLHLSNCVAIHSLAHMYTLSQLALKAADMIRRNFHKVIQDEEFYTLPFHLIRDWLSDLEITVDSEEVLFETVLKWVQRNAEERERYFEELFKLLRLSQMKPTYLTRHVKPERLVANNEVCVKLVADAVERHALRAENIQSGTCQHPTSHVSLLPRYGQNMDVIMVIGGVSEGGDYLSECVGYFVDEDRWVNLPHIHNHLDGHAVAVTESYVYVAGSMEPGFAKTVERYNPNLNTWEHVCSLMTRKHSFGLTEVKGKLYSIGGHGNFSPGFKDVTVYNPELDKWHNLESAPKILRDVKALAIEDRFVYIAARTPVDRDTEDGLKAVITCYDTETRQWQDVESLPLIDNYCFFQMSVVNSNFYQTASCCPKSYCLENEEAVRKIASQVSDEILESLPPEVLSIEGAAICYYKDDVFIIGGWKNSDDIDKQYRKEAYRYCAERKRWMLLPPMPQPRCRATACHVRIPYRYLHGTQRYPMPQNLMWQKDRIRQMQEIHRHALNMRRVPSSQIEC

SEQ ID NO: 2108 - protein, 525 aa, Homo sapiens
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHREGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 2109 - protein, 299 aa, Homo sapiens
MVRCLGPALLLLLLLGSASSVGGNRCVDAAEACTADARCQRLRSEYVAQCLGRAAQGGCPRARCRRALRRFFARGPPALTHALLFCPCAGPACAERRRQTFVPSCAFSGPGPAPPSCLEPLNFCERSRVCRCARAAAGPWRGWGRGLSPAHRPPAAQASPPGLSGLVHPSAQRPRRLPAGPGRPLPARLRGPRGVPAGTAVTPNYVDNVSARVAPWCDCGASGNRREDCEAFRGLFTRNRCLDGAIQAFASGWPPVLLDQLNPQGDPEHSLLQVSSTGRALERRSLLSILPVLALPALL

SEQ ID NO: 2110 - protein, 89 aa, Homo sapiens
MQACMVPGLALCLLLGPLAGAKPVQEEGDPYAELPAMPYWPFSTSDFWNYVQHFQALGAYPQIEDMARTFFAHFPLGSTLGFHVPYQED

SEQ ID NO: 2111 - protein, 220 aa, Homo sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRK

SEQ ID NO: 2112 - protein, 385 aa, Homo sapiens
MWGFRLLRSPPLLLLLPQLGIGNASSCSQARTMNPGGSGGARCSLSAEVRRRQCLQLSTVPGADPQRSNELLLLAAAGEGLERQDLPGDPAKEEPQPPPQHHVLYFPGDVQNYHEIMTRHPENYQWENWSLENVATILAHRFPNSYIWVIKCSRMHLHKFSCYDNFVKSNMFGAPEHNTDFGAFKHLYMLLVNAFNLSQNSLSKKSLNVWNKDSIASNCRSSPSHTTNGCQGEKVRTCEKSDESAMSFYPPSLNDASFTLIGFSKGCVVLNQLLFELKEAKKDKNIDAFIKSIRTMYWLDGGHSGGSNTWVTYPEVLKEFAQTGIIVHTHVTPYQVRDPMRSWIGKEHKKFVQILGDLGMQVTSQIHFTKEAPSIENHFRVHEVF

SEQ ID NO: 2113 - protein, 311 aa, Homo sapiens
MRGAARAAWGRAGQPWPRPPAPGPPPPPLPLLLLLLAGLLGGAGAQYSSDRCSWKGSGLTHEAHRKEVEQVYLRCAAGAVEWMYPTGALIVNLRPNTFSPARHLTVCIRSFTDSSGANIYLEKTGELRLLVPDGDGRPGRVQCFGLEQGGLFVEATPQQDIGRRTTGFQYELVRRHRASDLHELSAPCRPCSDTEVLLAVCTSDFAVRGSIQQVTHEPERQDSAIHLRVSRLYRQKSRVFEPVPEGDGHWQGRVRTLLECGVRPGHGDFLFTGHMHFGEARLGCAPRFKDFQRMYRDAQERGLNPCEVGTD

SEQ ID NO: 2114 - protein, 406 aa, Homo sapiens
MGPSTPLLILFLLSWSGPLQGQQHHLVEYMERRLAALEERLAQCQDQSSRHAAELRDFKNKMLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQLVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 2115 - protein, 299 aa, Homo sapiens
MGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 2116 - protein, 538 aa, Homo sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 2117 - protein, 324 aa, Homo sapiens
MSSEAETQQPPAAPPAAPALSAADTKPGTTGSGAGSGGPGGLTSAAPAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 2118 - protein, 69 aa, Homo sapiens
MRIFYYLHFLCYVTFILPATCTLVNADRCTKRYGRCKRDCLESEKQIDICSLPRKICCTEKLYEEDDMF

SEQ ID NO: 2119 - protein, 113 aa, Homo sapiens
MKLLTTICRLKLEKMYSKTNTSSTIFEKARHGTEKISTARSEGHHITFSRWKSCTAIGGRCKNQCDDSEFRISYCARPTTHCCVTECDPTDPNNWIPKDSVGTQEWYPKDSRH

SEQ ID NO: 2120 - protein, 1009 aa, Homo sapiens
MDLIRGVLLRLLLLASSLGPGAVSLRAAIRKPGKVGPPLDIKLGALNCTAFSIQWKMPRHPGSPILGYTVFYSEVGADKSLQEQLHSVPLSRDIPTTEEVIGDLKPGTEYRVSIAAYSQAGKGRLSSPRHVTTLSQDSCLPPAAPQQPHVIVVSDSEVALSWKPGASEGSAPIQYYSVEFIRPDFDKKWTSIHERIQMDSMVIKGLDPDTNYQFAVRAMNSHGPSPRSWPSDIIRTLCPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 2121 - protein, 423 aa, Homo sapiens
MSVRGILRLGTQEYPSPLDPEVGPYCDTPTMRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 2122 - protein, 393 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 2123 - protein, 652 aa, Homo sapiens
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGALYEQSCEAHKHRGNPSGLYYIDADGSGPLGPFLVYCNMTDAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEW

SEQ ID NO: 2124 - protein, 484 aa, Homo sapiens
MWYVSTRGVAPRVNFEGALFSGYAPDGGLFMPEELPQLDRGTLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKLSEAVTSVSVSDEAITQTMGRCWDENQYLLCPHSAVAVNYHYQQIDRQQPSTPRCCLAPASAAKFPEAVLAAGLTPETPAEIVALEHKETRCTLMRRGDNWMLMLRDTIEDLSRQWRSHALNTSQ

SEQ ID NO: 2125 - protein, 87 aa, Homo sapiens
MVSLMKLWIPMLMTFFCTVLLSVLGEMRKKRYDRKELLLEECWGKPNVKECTNKCSKAFRCKDKNYTCCWTYCGNICWINVETSGDY

SEQ ID NO: 2126 - protein, 150 aa, Homo sapiens
MRFMAGPAGSQSLGPLCFHSSPQALYTVLLIVLVMMSLVFGKFVPVNWEPPQPLPFPKYLRCYRCLLETKELGCLLGSDICLTPAGSSCITLHKKNSSGSDVMVSDCRSKEQMSDCSNTRTSPVSGFWIFSQYCFLDFCNDPQNRGLYTP

SEQ ID NO: 2127 - protein, 290 aa, Homo sapiens
MSVRRGRRPARPGTRLSWLLCCSALLSPAAGYVIVSSVSWAVTNEVDEELDSASTEEAMPALLEDSGSIWQQSFPASAHKEDAHLRPRAGAARARPPPAPPGMFSYRREGGQTASAPPGPRLRAATARSLAHASVWGCLATVSTHKKIQGLPFGNCLPVSDGPFNNSTGIPFFYMTAKDPVVADLMKNPMASLMLPESEGEFCRKNIVDPEDPRCVQLTLTGQMIAVSPEEVEFAKQAMFSRHPGMRKWPRQYEWFFMKMRIEHIWLQKWYGGASSISREEYFKAVPRKA

SEQ ID NO: 2128 - protein, 913 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 2129 - protein, 80 aa, Homo sapiens
MKLSGMFLLLSLALFCFLTGVFSQGGQVDCGEFQDPKVYCTRESNPHCGSDGQTYGNKCAFCKAIVKSGGKISLKHPGKC

SEQ ID NO: 2130 - protein, 89 aa, Homo sapiens
MKPWILLLVMFISGVVMLLPVLGSFWNKDPFLDMIRETEQCWVQPPYKYCEKRCTKIMTCVRPNHTCCWTYCGNICLDNEEPLKSMLNP

SEQ ID NO: 2131 - protein, 87 aa, Homo sapiens
MLPCLALLLLMELSVCTVAGDGGEEQTLSTEAETWEGAGPSIQLQLQEVKTGKASQFFGLMGKRVGGRPLIQPRRKKGREDEAQGSE

SEQ ID NO: 2132 - protein, 94 aa, Homo sapiens
MQHSLVFFFAVILHLSHLLHLDASIHPFRLPFSSKPFLLIPMSNTTLPHTAWPLSFLHQTVSTLKAVAVTHSLWHLQIPVDCQACNRKSKKIYC

SEQ ID NO: 2133 - protein, 108 aa, Homo sapiens
MRQRLLPSVTSLLLVALLFPGSSQARHVNHSATEALGELRERAPGQGTNGFQLLRHAVKRDLLPPRTPPYQGDVPLGIRNTICRMQQGICRLFFCHSGTGQQHRQRCG

SEQ ID NO: 2134 - protein, 268 aa, Homo sapiens
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFEVKPYNVYITVAYPPDTDTPGFAEENRTKPLETRLISETTSVCKPEQVAKQIVKDAIQGNFNSSLGSDGYMLSALTCGMAPVTSITEGLQQVVTMGLFRTIALFYLGSFDSIVRRCMMQREKSENADKTA

SEQ ID NO: 2135 - protein, 561 aa, Homo sapiens
MRWILCWSLTLCLMAQTALGALHTKRPQVVTKYGTLQGKQMHVGKTPIQVFLGVPFSRPPLGILRFAPPEPPEPWKGIRDATTYPPGCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRDAGLPVYLYEFEHHARGIIVKPRTDGADHGDEMYFLFGGPFATGLSMGKEKALSLQMMKYWANFARTGNPNDGNLPCWPRYNKDEKYLQLDFTTRVGMKLKEKKMAFWMSLYQSQRPEKQRQF

SEQ ID NO: 2136 - protein, 147 aa, Homo sapiens
MASSLKIWGTLLALLCILCTLLVQSKEVSWREFMKQHYLSPSREFREYKCDVLMRENEALKDKSSHMFIYISWYKIEHICTSDNWMDRFRNAYVWVQNPLKVLKCHQENSKNSYTESRSFNYIEFHCSMDGYVDSIEDLKMVEPIGN

SEQ ID NO: 2137 - protein, 147 aa, Homo sapiens
MTSSLKIWGILLALLCILCRLCVYSNNIYWREFIKLHYLSPSREFKEYKCDVLMREKEALKGKSFHMFIYSLWFKIQRACINEKGSDRYRNAYVWAPGALKVLECHWEKYNNRYTESRSFSYIEFHCGVDGYVDNIEDLRIIEPISN

SEQ ID NO: 2138 - protein, 415 aa, Homo sapiens
MSPFLYLVLLVLGLHATIHCASPEGKVTACHSSQPNATLYKMSSINADFAFNLYRRFTVETPDKNIFFSPVSISAALVMLSFGACCSTQTEIVETLGFNLTDTPMVEIQHGFQHLICSLNFPKKELELQIGNALFIGKHLKPLAKFLNDVKTLYETEVFSTDFSNISAAKQEINSHVEMQTKGKVVGLIQDLKPNTIMVLVNYIHFKAQWANPFDPSKTEDSSSFLIDKTTTVQVPMMHQMEQYYHLVDMELNCTVLQMDYSKNALALFVLPKEGQMESVEAAMSSKTLKKWNRLLQKGWVDLFVPKFSISATYDLGATLLKMGIQHAYSENADFSGLTEDNGLKLSNAAHKAVLHIGEKGTEAAAVPEVELSDQPENTFLHPIIQIDRSFMLLILERSTRSILFLGKVVNPTEA

SEQ ID NO: 2139 - protein, 94 aa, Homo sapiens
MRTLAILAAILLVALQAQAEPLQARADEVAAAPEQIAADIPEVVVSLAWDESLAPKHPGSRKNMDCYCRIPACIAGERRYGTCIYQGRLWAFCC

SEQ ID NO: 2140 - protein, 353 aa, Homo sapiens
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 2141 - protein, 216 aa, Homo sapiens
MKLNLVQIFFMLLMLLLGLGMGLGLGLHMATAVLEESDQPLNEFWSSDSQDKAEATEEGDGTQTTETLVLSNKEVVQPGWPEDPILGEDEVGGNKMLRASALFQSNKDYLRLDQTDRECNDMMAHKMKEPSQSCIAQYAFIHEDLNTVKAVCNSPVIACELKGGKCHKSSRPFDLTLCELSQPDQVTPNCNYLTSVIKKHIIITCNDMKRQLPTGQ

SEQ ID NO: 2142 - protein, 73 aa, Homo sapiens
MRIAVLLFAIFFFMSQVLPARGKFKEICERPNGSCRDFCLETEIHVGRCLNSQPCCLPLGHQPRIESTTPKKD

SEQ ID NO: 2143 - protein, 202 aa, Homo sapiens
MERGAGAKLLPLLLLLRATGFTCAQTDGRNGYTAVIEVTSGGPWGDWAWPEMCPDGFFASGFSLKVEPPQGIPGDDTALNGIRLHCARGNVLGNTHVVESQSGSWGEWSEPLWCRGGAYLVAFSLRVEAPTTLGDNTAANNVRFRCSDGEELQGPGLSWGDFGDWSDHCPKGACGLQTKIQGPRGLGDDTALNDARLFCCRS

SEQ ID NO: 2144 - protein, 252 aa, Homo sapiens
MQLTRCCFVFLVQGSLYLVICGQDDGPPGSEDPERDDHEGQPRPRVPRKRGHISPKSRPMANSTLLGLLAPPGEAWGILGQPPNRPNHSPPPSAKVKKIFGWGDFYSNIKTVALNLLVTGKIVDHGNGTFSVHFQHNATGQGNISISLVPPSKAVEFHQEQQIFIEAKASKIFNCRMEWEKVERGRRTSLCTHDPAKICSRDHAQSSATWSCSQPFKVVCVYIAFYSTDYRLVQKVCPDYNYHSDTPYYPSG

SEQ ID NO: 2145 - protein, 184 aa, Homo sapiens
MKILVAFLVVLTIFGIQSHGYEVFNIISPSNNGGNVQETVTIDNEKNTAIINIHAGSCSSTTIFDYKHGYIASRVLSRRACFILKMDHQNIPPLNNLQWYIYEKQALDNMFSSKYTWVKYNPLESLIKDVDWFLLGSPIEKLCKHIPLYKGEVVENTHNVGAGGCAKAGLLGILGISICADIHV

SEQ ID NO: 2146 - protein, 216 aa, Homo sapiens
MGAVMGTFSSLQTKQRRPSKDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 2147 - protein, 911 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 2148 - protein, 283 aa, Homo sapiens
MGLGLRGWGRPLLTVATALMLPVKPPAGSWGAQIIGGHEVTPHSRPYMASVRFGGQHHCGGFLLRARWVVSAAHCFSHRDLRTGLVVLGAHVLSTAEPTQQVFGIDALTTHPDYHPMTHANDICLLRLNGSAVLGPAVGLLRPPGRRARPPTAGTRCRVAGWGFVSDFEELPPGLMEAKVRVLDPDVCNSSWKGHLTLTMLCTRSGDSHRRGFCSADSGGPLVCRNRAHGLVSFSGLWCGDPKTPDVYTQVSAFVAWIWDVVRRSSPQPGPLPGTTRPPGEAA

SEQ ID NO: 2149 - protein, 402 aa, Homo sapiens
MMVALRGASALLVLFLAAFLPPPQCTQDPAMVHYIYQRFRVLEQGLEKCTQATRAYIQEFQEFSKNISVMLGRCQTYTSEYKSAVGNLALRVERAQREIDYIQYLREADECIESEDKTLAEMLLQEAEEEKKIRTLLNASCDNMLMGIKSLKIVKKMMDTHGSWMKDAVYNSPKVYLLIGSRNNTVWEFANIRAFMEDNTKPAPRKQILTLSWQGTGQVIYKGFLFFHNQATSNEIIKYNLQKRTVEDRMLLPGGVGRALVYQHSPSTYIDLAVDEHGLWAIHSGPGTHSHLVLTKIEPGTLGVEHSWDTPCRSQDAEASFLLCGVLYVVYSTGGQGPHRITCIYDPLGTISEEDLPNLFFPKRPRSHSMIHYNPRDKQLYAWNEGNQIIYKLQTKRKLPLK

SEQ ID NO: 2150 - protein, 406 aa, Homo sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 2151 - protein, 541 aa, Homo sapiens
MRLSPFHLQLEFHMKEKREDLQISWSFISVPEMAVNIQPKALGEDQVAETSAMSDVLKDILKHLAGSASPSVVLITKPTTVKEAQNLQCAASTAQESCPPKPPRAHELKLLVRNIHVLLLSEPGASGHINAVCVVQLNDPVQRFSSTLTKNTPDLMWEEEFTFELNAKSKELHLQISEAGRSSEGLLATATVPLDLFKKQPSGPQSFTLTSGSACGSSVLGSVTAEFSYMEPGELKSWPIPPPVPAAKIEKDRTVMPCGTVVTTVTAVKTKPRVDVGRASPLSSDSPVKTPIKVKVIEKDISVQAIACRSAPVSKTLSSSDTELLVLNGSDPVAEVAIRQLSESSKLKLKSPRKKSTIIISGISKTSLSQDHDAALMQGYTASVDSTHQEDAPSHPERAAASAPPEEAESAQASLAPKPQEDELDSWDLEKEPQAAAWSSQVLLDPDGDELSESSMSVLEPGTAKKHKGGILRKGAKLFFRRRHQQKDPGMSQSHNDLVFLEQPEGSRRKGITLTRILNKKLLSRHRNKNTMNGAPVEPCT

SEQ ID NO: 2152 - protein, 330 aa, Homo sapiens
MAFLPSWVCVLVGSFSASLAGTSNLSETEPPLWKESPGQLSDYRVENSMYIINPWVYLERMGMYKIILNQTARYFAKFAPDNEQNILWGLPLQYGWQYRTGRLADPTRRTNCGYESGDHMCISVDSWWADLNYFLSSLPFLAAVDSGVMGISSDQVRLLPPPKNERKFCYDVSSCRSSFPETMNKWNTFYQYLQSPFSKFDDLLKYLWAAHTSTLADNIKSFEDRYDYYSKAEAHFERSWVLAVDHLAAVLFPTTLIRSYKFQKGMPPRILLNTDVAPFISDFTAFQNVVLVLLNMLDNVDKSIGYLCTEKSNVYRDHSESSSRSYGNNS

SEQ ID NO: 2153 - protein, 270 aa, Homo sapiens
MDSLEWNWALVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 2154 - protein, 312 aa, Homo sapiens
MGVMAMLMLPLLLLGISGLLFIYQEVSRLWSKSAVQNKVVVITDAISGLGKECARVFHTGGARLVLCGKNWERLENLYDALISVADPSKQTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTYAASKHAALGFFDCLRAEVEEYDVVISTVSPTFIRSYHVYPEQGNWEASIWKFFFRKLTYGVHPVEVAEEVMRTVRRKKQEVFMANPIPKAAVYVRTFFPEFFFAVVACGVKEKLNVPEEG

SEQ ID NO: 2155 - protein, 245 aa, Homo sapiens
MASTALLALCSTGAFSGLAVEAGAGVCHATPIYAGHSWHQATFRLNVAGSTLSRYLRDLLVAANPDLLQQALPRKAITHLKKRSCYVSLDFEGDLRDPARHHPASFSVGNGCCVCLSSERFRCPEPIFQPGLLGQAEQGLPALAFRALQKMPKTLRTRLADTVVLAGGSTLFPGFAERLDKELEAQCRRHGYAALRPHLVAKHGRGMAVWTGGSMVASLHSFQRRWITRAMYQECGSRLLYDVFN

SEQ ID NO: 2156 - protein, 302 aa, Homo sapiens
MRRWAWAAVVVLLGPQLVLLGGVGARREAQRTQQPGQRADPPNATASASSREGLPEAPKPSQASGPEFSDAHMTWLNFVRRPDDGALRKRCGSRDKKPRDLFGPPGPPGAEVTAETLLHEFQELLKEATERRFSGLLDPLLPQGAGLRLVGEAFHCRLQGPRRVDKRTLVELHGFQAPAAQGAFLRGSGLSLASGRFTAPVSGIFQFSASLHVDHSELQGKARLRARDVVCVLICIESLCQRHTCLEAVSGLESNSRVFTLQVQGLLQLQAGQYASVFVDNGSGAVLTIQAGSSFSGLLLGT

SEQ ID NO: 2157 - protein, 471 aa, Homo sapiens
MDSAPLFPRPHLFQNLLLFLWALLNCGLGVSAQGPGEWTPWVSWTRCSSSCGRGVSVRSRRCLRLPGEEPCWGDSHEYRLCQLPDCPPGAVPFRDLQCALYNGRPVLGTQKTYQWVPFHGAPNQCDLNCLAEGHAFYHSFGRVLDGTACSPGAQGVCVAGRCLSAGCDGLLGSGALEDRCGRCGGANDSCLFVQRVFRDAGAFAGYWNVTLIPEGARHIRVEHRSRNHLALMGGDGRYVLNGHWVVSPPGTYEAAGTHVVYTRDTGPQETLQAAGPTSHDLLLQVLLQEPNPGIEFEFWLPRERYSPFQARVQALGWPLRQPQPRGVEPQPPAAPAVTPAQTPTLAPDPCPPCPDTRGRAHRLLHYCGSDFVFQARVLGHHHQAQETRYEVRIQLVYKNRSPLRAREYVWAPGHCPCPMLAPHRDYLMAVQRLVSPDGTQDQLLLPHAGYARPWSPAEDSRIRLTARRCPG

SEQ ID NO: 2158 - protein, 73 aa, Homo sapiens
MAPQTLLLVLVLCVLLLQAQGGYRDKMRMQRIKVCEKRPSIDLCIHHCSYFQKCETNKICCSAFCGNICMSIL

SEQ ID NO: 2159 - protein, 782 aa, Homo sapiens
MARARAGALLALWVLGAAAHPQCLDFRPPFRPTQPLRLCAQYSDFGCCDEGRDAELTRRFWALASRVDAAEWAACAGYARDLLCQECSPYAAHLYDAEDPFTPLRTVPGLCQDYCLDMWHKCRGLFRHLSTDQELWALEGNLARFCRYLSLDDTDYCFPYLLVNKNLNSNLGHVVADAKGCLQLCLEEVANGLRNPVAMVHARDGTHRFFVAEQVGLVWAYLPDRSRLGKPFLNISRVVLTSPWEGDERGFLGIAFHPSFQHNRRLYVYYSVGIRSSEWIRISEFRVSEDDENAVDHSSERIILEVKEPASNHNGGQLLFGDDGYLYIFTGDGGMAGDPFGTFGNAQNKSALLGKVLRIDVDRKERGLPYGIPPDNPFVGDPAAQPEVYALGVRNMWRCSFDRGDPSSGTGRGRLFCGDVGQNKFEEVDVVERGGNYGWRAREGFECYDRSLCANTSLNDLLPIFAYPHTVGKSVTGGYVYRGCEYPNLNGLYIFGDFMSGRLMSLQENPGTGQWQYSEICMGHGQTCEFPGLINNYYPYIISFGEDEAGELYFMSTGEPSATAPRGVVYKIIDASRRAPPGKCQIQPAQVKIRSRLIPFVPKEKFIPKTRSTPRPTARAPTRAPRRGRPTAAPPAPTPRPARPTQQPGSRRGGGRRRGRLNSASRAFRDGEVRLVRPAGLSSGSGRVEVFVGGRWGTVCDDSWNISGAAVVCRQLGFAYAVRAVKRAEFGQGGSLPILLDDVRCAGWERNLLECQHNGVGTHNCEHDEDAGVVCSHQNPDL

SEQ ID NO: 2160 - protein, 438 aa, Homo sapiens
MHPLPGYWSCYCLLLLFSLGVQGSLGAPSAAPEQVHLSYPGEPGSMTVTWTTWVPTRSEVQFGLQPSGPLPLRAQGTFVPFVDGGILRRKLYIHRVTLRKLLPGVQYVYRCGSAQGWSRRFRFRALKNGAHWSPRLAVFGDLGADNPKAVPRLRRDTQQGMYDAVLHVGDFAYNLDQDNARVGDRFMRLIEPVAASLPYMTCPGNHEERYNFSNYKARFSMPGDNEGLWYSWDLGPAHIISFSTEVYFFLHYGRHLVQRQFRWLESDLQKANKNRAARPWIITMGHRPMYCSNADLDDCTRHESKVRKGLQGKLYGLEDLFYKYGVDLQLWAHEHSYERLWPIYNYQVFNGSREMPYTNPRGPVHIITGSAGCEERLTPFAVFPRPWSAVRVKEYGYTRLHILNGTHIHIQQVSDDQDGKIVDDVWVVRPLFGRRMYL

SEQ ID NO: 2161 - protein, 136 aa, Homo sapiens [sequence omitted]

SEQ ID NO: 2162 - protein, 402 aa, Homo sapiens
MAARPGPLWLLGLTLCALGGGGPGLRPPPGCPQRRLGARERRDVQREILAVLGLPGRPRPRAPPAASRLPASAPLFMLDLYHAMAGDDDEDGAPAEQRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVRGSHGRQVCRRHELYVSFQDLGWLDWVIAPQGYSAYYCEGECSFPLDSCMNATNHAILQSLVHLMKPNAVPKACCAPTKLSATSVLYYDSSNNVILRKHRNMVVKACGCH

SEQ ID NO: 2163 - protein, 318 aa, Homo sapiens
MAAAALPPRPLLLLPLVLLLSGRPTRADSKVFGDLDQVRMTSEGSDCRCKCIMRPLSKDACSRVRSGRARVEDFYTVETVSSGTDCRCSCTAPPSSLNPCENEWKMEKLKKQAPELLKSIKANLSRENEVVKDSVRHLSEQLRHYENHSAIMLGIKKELSRLGLQLLQKDAAAAPATPATGTGSKAQDTARGKGKDISKYGSVQKSFADRGLPKPPKEKLLQVEKLRKESGKGSFLQPTAKPRALAQQQAVIRGFTYYKAGKQEVTEAVADNTLQGTSWLEQLPPKVEGRSNSAEPNSAEQDEAEPRSSERVDLASGT

SEQ ID NO: 2164 - protein, 133 aa, Homo sapiens
MALGVPISVYLLFNAMTALTEEAAVTVTPPITAQQADNIEGPIALKFSHLCLEDHNSYCINGACAFHHELEKAICRCFTGYTGERCEHLTLTSYAVDSYEKYIAIGIGVGLLLSGFLVIFYCYIRKRYEKDKI

SEQ ID NO: 2165 - protein, 216 aa, Homo sapiens
MSSEAETQQPPAAPPAAPALSAADTKPGTTGSGAGSGGPGGLTSAAPAGGDKKVIATKVLGTVKWFNVRNGYGFINRNDTKEDVFVHQGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFR

SEQ ID NO: 2166 - protein, 251 aa, Homo sapiens
NDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARVNIPSGFFTMASMSHSTPLSAKTTTSVLPSPCARLKTWSAL

SEQ ID NO: 2167 - protein, 191 aa, Homo sapiens
MAAPRGRAAPWTTALLLLLASQVLSPGSCADEEEVPEEWVLLHVVQGQIGAGNYSYLRLNHEGKIVLRMRSLKGDADLYVSASSLHPSFDDYELQSATCGPDAVSIPAHFRRPVGIGVYGHPSHLESEFEMKVYYDGTVEQHPFGEAAYPADGADAGQKHAGAPEDASQEEESVLWTILISILKLVLEILF

SEQ ID NO: 2168 - protein, 766 aa, Homo sapiens
MGRRRLLVWLCAVAALLSGAQARGTPLLARPAPPGASRYSLYTTGWRPRLRPGPHKALCAYVVHRNVTCILQEGAESYVKAEYRQCRWGPKCPGTVTYRTVLRPKYKVGYKTVTDLAWRCCPGFTGKRCPEHLTDHGAASPQLEPEPQIPSGQLDPGPRPPSYSRAAPSPHGRKGPGLFGERLERLEGDVQRLAQTYGTLSGLVASHEDPNRMTGGPRAPAVPVGFGVIPEGLVGPGDRARGPLTPPLDEILSKVTEVSNTLQTKVQLLDKVHGLALGHEAHLQRLREAPPSPLTSLALLEEYVDRRLHRLWGSLLDGFEQKLQGVQSECDLRVQEVRRQCEEGQAASRRLHQSLDGRELALRQELSQLGSQLQGLSVSGRGSCCGQLALINARMDGLERALQAVTETQRGPGAPAGDELTRLSAAMLEGGVDGLLEGLETLNGTEGGARGCCLRLDMGGWGVGGFGTMLEERVQSLEERLATLAGELSHDSASPGRSARPLVQTELAVLEQRLVSLETSCTPSTTSAILDSLVAEVKAWQSRSEALLRQVASHAALLQQLNGTVAEVQGQLAEGTGSSLQGEITLLKVNLNSVSKSLTGLSDSVSQYSDAFLAANTSLDERERKVEAEVQAIQEQVSSQGSRLQAGHRQVLNLRGELEQLKAGVAKVASGLSRCQDTAQKLQHTVGHFDQRVAQVEGACRRLGLLAAGLDSLPTEPLRPREGLWSHVDQLNRTLAQHTQDIARLRDDLLDCQAQLAEQVRPGQAN

SEQ ID NO: 2169 - protein, 416 aa, Homo sapiens
MYRHGISSQRSWPLWTTIFIFLGVAAILGVTIGLLVHFLAVEKTYYYQGDFHISGVTYNDNCENAASQASTNLSKDIETKMLNAFQNSSIYKEYVKSEVIKLLPNANGSNVQLQLKFKFPPAEGVSMRTKIKAKLHQMLKNNMASWNAVPASIKLMEISKAASEMLTNNCCGRQVANSIITGNKIVNGKSSLEGAWPWQASMQWKGRHYCGASLISSRWLLSAAHCFAKKNNSKDWTVNFGIVVNKPYMTRKVQNIIFHENYSSPGLHDDIALVQLAEEVSFTEYIRKICLPEAKMKLSENDNVVVTGWGTLYMNGSFPVILQEDFLKIIDNKICNASYAYSGFVTDTMLCAGFMSGEADACQNDSGGPLAYPDSRNIWHLVGIVSWGDGCGKKNKPGVYTRVTSYRNWITSKTGL

SEQ ID NO: 2170 - protein, 212 aa, Homo sapiens
MLSSVVFWGLIALIGTSRGSYPFSHSMKPHLHPRLYHGCYGDIMTMKTSGATCDANSVMNCGIRGSEMFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVAQHLKGGLSAFKSGIEAIATPSDIDNDFVNDIIARAKFYKRQSF

SEQ ID NO: 2171 - protein, 125 aa, Homo sapiens
MARSATLAAAALALCLLLAPPGLAWYKPAAGHSSYSVGRAAGLLSGLRRSPYARRSQPYRGAEPPGGAGASPELQLHPRLRSLAVCVQDVAPNLQRCERLPDGRGTYQCKANVFLSLRAADCLAA

SEQ ID NO: 2172 - protein, 288 aa, Homo sapiens
MNNLSFSELCCLFCCPPCPGKIASKLAFLPPDPTYTLMCDESGSRWTLHLSERADWQYSSREKDAIECFMTRTSKGNRIACMFVRCSPNAKYTLLFSHGNAVDLGQMSSFYIGLGSRINCNIFSYDYSGYGASSGKPTEKNLYADIEAAWLALRTRYGIRPENVIIYGQSIGTVPSVDLAARYESAAVILHSPLTSGMRVAFPDTKKTYCFDAFPNIDKISKITSPVLIIHGTEDEVIDFSHGLALFERCQRPVEPLWVEGAGHNDVELYGQYLERLKQFVSQELVNL

SEQ ID NO: 2173 - protein, 138 aa, Homo sapiens
MVAPAARVFLRAVRAALTSTVPDLLCLLARGSPRGLASGRLPLAVHSAQHGPGSGAPWLRIARRALRFVLSKHWGDDCYLTNRLWQDLKPPSHVENGQELRLAPPVQWALQVQGNQLQTAVLCLRMAPPEPAGSRQRI

SEQ ID NO: 2174 - protein, 443 aa, Homo sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAASSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWGEGLHQLREALKILAERVLILETMIGLYEPELGSGAGPAGTGTPSLLRGKRGGHATNYRIVAPRSRDERG

SEQ ID NO: 2175 - protein, 238 aa, Homo sapiens
MVLLLLVAIPLLVHSSRGPAHYEMLGRCRMVCDPHGPRGPGPDGAPASVPPFPPGAKGEVGRRGKAGLRGPPGPPGPRGPPGEPGRPGPPGPPGPGPGGVAPAAGYVPRIAFYAGLRRPHEGYEVLRFDDVVTNVGNAYEAASGKFTCPMPGVYFFAYHVLMRGGDGTSMWADLMKNGQVRASAIAQDADQNYDYASNSVILHLDVGDEVFIKLDGGKVHGGNTNKYSTFSGFIIYPD

SEQ ID NO: 2176 - protein, 93 aa, Homo sapiens
MKLFLVLIILLFEVLTDGARLKKCFNKVTGYCRKKCKVGERYEIGCLSGKLCCANDEEEKKHVSFKKPHQHSGEKLSVLQDYIILPTITIFTV

SEQ ID NO: 2177 - protein, 202 aa, Homo sapiens
MVRIWTTIMIVLILLLRIGPNKPSLSGRQAPAQAQTSDLVPSLFPLGLWAPGFCTWSSPDEDKVWRPAWEQGPKGEPDPRGLRPRKPVPGTGNRDSGTRRRLQDATEQDPRPGNDVASAETAGPPSPSGIRAQDRAPRHRRAPPARMPVAPAPSADGEPLQEQGGGLFHRTRSVYNGLELNTWMKVERLFVEKFHQSFSLDN

SEQ ID NO: 2178 - protein, 113 aa, Homo sapiens
MLPCLALLLLMELSVCTVAGDGGEEQTLSTEAETWVIVALEEGAGPSIQLQLQEVKTGKASQFFGLMGKRVGGRPLIQPRRKKAYQLEHTFQGLLGKRSLFTEGREDEAQGSE

SEQ ID NO: 2179 - protein, 422 aa, Homo sapiens
MGPAWLWLLGTGILASVHCQPLLAHGDKSLQGPQPPRHQLSEPAPAYHRITPTITNFALRLYKELAADAPGNIFFSPVSISTTLALLSLGAQANTSALILEGLGFNLTETPEADIHQGFRSLLHTLALPSPKLELKVGNSLFLDKRLKPRQHYLDSIKELYGAFAFSANFTDSVTTGRQINDYLRRQTYGQVVDCLPEFSQDTFMVLANYIFFKAKWKHPFSRYQTQKQESFFVDERTSLQVPMMHQKEMHRFLYDQDLACTVLQIEYRGNALALLVLPDPGKMKQVEAALQPQTLRKWGQLLLPSLLDLHLPRFSISGTYNLEDILPQIGLTNILNLEADFSGVTGQLNKTISKVSHKAMVDMSEKGTEAGAASGLLSQPPSLNTMSDPHAHFNRPFLLLLWEVTTQSLLFLGKVVNPVAG

SEQ ID NO: 2180 - protein, 78 aa, Homo sapiens
MALIRKTFYFLFAMFFILVQLPSGCQAGLDFSQPFPSGEFAVCESCKLGRGKCRKECLENEKPDGNCRLNFLCCRQRI

SEQ ID NO: 2181 - protein, 712 aa, Homo sapiens
MAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVVS

SEQ ID NO: 2182 - protein, 70 aa, Homo sapiens
MRVLFFVFGVLSLMFTVPPARSFISNDECPSEYYHCRLKCNADEHAIRYCADFSICCKLKIIEIDGQKKW

SEQ ID NO: 2183 - protein, 262 aa, Homo sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVLFLMMSGAPDTGGQGGGGGGGGGGGSGR

SEQ ID NO: 2184 - protein, 49 aa, Homo sapiens
MDSSREPTLGRLDAAGFWQVWQRFDADGHGHESKFAQGETAVYDYPRCL

SEQ ID NO: 2185 - protein, 70 aa, Homo sapiens
MPGAMKIFVFILAALILLAQIFQARTAIHRALISKRMEGHCEAECLTFEVKIGGCRAELAPFCCKNRKKH

SEQ ID NO: 2186 - protein, 236 aa, Homo sapiens
MMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYGLRVPGCLQFPHTLLPWAPELYTPATYQLTEEGTFKVVDEEAMEKVPWIPLDPLAPDLARYPSYSQAQALRCTVRAGEMLYLPALWFHHVQQSQGCIAVNFWYDMEYDLKYSYFQLLDSLTKASGLD

SEQ ID NO: 2187 - protein, 365 aa, Homo sapiens
MAPKLITVLCLGFCLNQKICPHAGAQDKFSLSAWPSPVVPLGGRVTLSCHSHLRFVIWTIFQTTGTRSHELHTGLSNNITISPVTPEHAGTYRCVGIYKHASKWSAESNSLKIIVTGLFTKPSISAHPSSLVHAGARVSLRCHSELAFDEFILYKEGHIQHSQQLDQGMEAGIHYVEAVFSMGPVTPAHAGAYRCCGCFSHSRYEWSAPSDPLDIVITGKYKKPSLSTQVDPMMRLGEKLTLFCSSEISFDQYHLFRHGVAHGQWLSGGQRHREAFQANFSVGRATPVPGGTYRCYGSFNDSPYKPPVTRCNFTPQETLRVLLCHSQNPPLNLTPPWQTQSPRKANGRMKRSLQQKRHRRSYMPS

SEQ ID NO: 2188 - protein, 65 aa, Homo sapiens
MRTFLFLFAVLFFLTPAKNAFFDEKCNKLKGTCKNNCGKNEELIALCQKSLKCCRTIQPCGSIID

SEQ ID NO: 2189 - protein, 65 aa, Homo sapiens; identical to SEQ ID NO: 2188

SEQ ID NO: 2190 - protein, 78 aa, Homo sapiens; identical to SEQ ID NO: 2180

SEQ ID NO: 2191 - protein, 955 aa, Homo sapiens
MWAGLLLRAACVALLLPGAPARGYTGRKPPGHFAAERRRLGPHVCLSGFGSGCCPGWAPSMGGGHCTLPLCSFGCGSGICIAPNVCSCQDGEQGATCPETHGPCGEYGCDLTCNHGGCQEVARVCPVGFSMTETAVGIRCTDIDECVTSSCEGHCVNTEGGFVCECGPGMQLSADRHSCQDTDECLGTPCQQRCKNSIGSYKCSCRTGFHLHGNRHSCVDVNECRRPLERRVCHHSCHNTVGSFLCTCRPGFRLRADRVSCEAFPKAVLAPSAILQPRQHPSKMLLLLPEAGRPALSPGHSPPSGAPGPPAGVRTTRLPSPTPRLPTSSPSAPVWLLSTLLATPVPTASLLGNLRPPSLLQGEVMGTPSSPRGPESPRLAAGPSPCWHLGAMHESRSRWTEPGCSQCWCEDGKVTCEKVRCEAACSHPIPSRDGGCCPSCTGCFHSGVVRAEGDVFSPPNENCTVCVCLAGNVSCISPECPSGPCQTPPQTDCCTCVPVRCYFHGRWYADGAVFSGGGDECTTCVCQNGEVECSFMPCPELACPREEWRLGPGQCCFTCQEPTPSTGCSLDDNGVEFPIGQIWSPGDPCELCICQADGSVSCKRTDCVDSCPHPIRIPGQCCPDCSAGCTYTGRIFYNNETFPSVLDPCLSCICLLGSVACSPVDCPITCTYPFHPDGECCPVCRDCNYEGRKVANGQVFTLDDEPCTRCTCQLGEVSCEKVPCQRACADPALLPGDCCSSCPDSLSPLEEKQGLSPHGNVAFSKAGRSLHGDTEAPVNCSSCPGPPTASPSRPVLHLLQLLLRTNLMKTQTLPTSPAGAHGPHSLALGLTATFPGEPGASPRLSPGPSTPPGAPTLPLASPGAPQPPPVTPERSFSASGAQIVSRWPPLPGTLLTEASALSMMDPSPSKTPITLLGPRVLSPTTSRLSTALAATTHPGPQQPPVGASRGEESTM

SEQ ID NO: 2192 - protein, 89 aa, Homo sapiens
MVSCERRASKSVGQILLWDFGYTCRLSHRRRNSTEILSRNLPALYTGIKVCEKRPSIDLCIHHCSYFQKCETNKICCSAFCGNICMSIL

SEQ ID NO: 2193 - protein, 199 aa, Homo sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 2194 - protein, 242 aa, Homo sapiens
MAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFIRWLLKLGHHGRAPPRRSGALPPAPAAPRPALRAQRAGPAGPGAKG

SEQ ID NO: 2195 - protein, 208 aa, Homo sapiens
MLGLLVALLALGLAVFALLDVWYLVRLPCAVLRARLLQPRVRDLLAEQRFPGRVLPSDLDLLLHMNNARYLREADFARVAHLTRCGVLGALRELRAHTVLAASCARHRRSLRLLEPFEVRTRLLGWDDRAFYLEARFVSLRDGFVCALLRFRQHLLGTSPERVVQHLCQRRVEPPELPADLQHWISYNEASSQLLRMESGLSDVTKDQ

SEQ ID NO: 2196 - protein, 140 aa, Homo sapiens
MLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 2197 - protein, 117 aa, Homo sapiens
MLSKAHGCKTALSLGRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKRFP

SEQ ID NO: 2198 - protein, 775 aa, Homo sapiens
MHPGPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 2199 - protein, 418 aa, Homo sapiens
MRTLFNLLWLALACSPVHTTLSKSDAKKAASKTLLEKVKFCSCCPGWSAMARSWLTATSATQSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 2200 - protein, 270 aa, Homo sapiens
MMLRLLSSLLLVAVASGYGPPSSRPSSRVVNGEDAVPYSWPWQVSLQYEKSGSFYHTCGGSLIAPDWVVTAGHCISSSRTYQVVLGEYDRAVKEGPEQVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEETIASH

SEQ ID NO: 2201 - protein, 194 aa, Homo sapiens; identical to SEQ ID NO: 1914

SEQ ID NO: 2202 - protein, 435 aa, Homo sapiens
MQGQGRRRGTCKDIFCSKMASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 2203 - protein, 130 aa, Homo sapiens
MASDLIRTILAVALISKLGTAVDAELMPSGAILQNKRENLPRVCHALAFLGMARCQDLFLVRLQGWKLGTRFQDGPRSTPQEEGGSPQRKRGMPVQIHFLLKSFLSSPITFAFISLARTVSLATAICKIV

SEQ ID NO: 2204 - protein, 278 aa, Homo sapiens
MQWLRVRESPGEATGHRVTMGTAALGPVWAALLLFLLMCEIPMVELTFDRAVASGCQRCCDSEDPLDPAHVSSASSSGRPHALPEIRPYINITILKGDKGDPGPMGLPGYMGREGPQGEPGPQGSKGDKGEMGSPGAPCQKRFFAFSVGRKTALHSGEDFQTLLFERVFVNLDGCFDMATGQFAAPLRGIYFFSLNVHSWNYKETYVHIMHNQKEAVILYAQPSERSIMQSQSVMLDLAYGDRVWVRLFKRQRENAIYSNDFDTYITFSGHLIKAEDD

SEQ ID NO: 2205 - protein, 544 aa, Homo sapiens
MCTVVDPRIVRRYLLRRQLGQGAYGIVWKAVDRRTGEVVAIKKIFDAFRDKTDAQRTFREITLLQEFGDHPNIISLLDVIRAENDRDIYLVFEFMDTDLNAVIRKGGLLQDVHVRSIFYQLLRATRFLHSGHVVHRDQKPSNVLLDANCTVKLCDFGLARSLGDLPEGPEDQAVTEYVATRWYRAPEVLLSSHRYTLGVDMWSLGCILGEMLRGRPLFPGTSTLHQLELILETIPPPSEEDLLALGSGCRASVLHQLGSRPRQTLDALLPPDTSPEALDLLRRLLVFAPDKRLSATQALQHPYVQRFHCPSDEWAREADVRPRAHEGVQLSVPEYRSRVYQMILECGGSSGTSREKGPEGVSPSQAHLHKPRADPQLPSRTPVQGPRPRPQSSPGHDPAEHESPRAAKNVPRQNSAPLLQTALLGNGERPPGAKEAPPLTLSLVKPSGRGAAPSLTSQAAAQVANQALIRGDWNRGGGVRVASVQQVPPRLPPEARPGRRMFSTSALQGAQGGARALLGGYSQAYGTVCHSALGHLPLLEGHHV

SEQ ID NO: 2206 - protein, 132 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 2207 - protein, 466 aa, Homo sapiens
MKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 2208 - protein, 173 aa, Homo sapiens
MHWKMLLLLLLYYNAEASMCHRWSRAVLFPAAHRPKRSSSLPLNPVLQTSLEEVELLYEFLLAELEISPDLQISIKDEELASLRKASDFRTVCNNVIPKSIPDIRRLSASLSSHPGILKKEDFERTVLTLAYTAYRTALSHGHQKDIWAQSLVSLFQALRHDLMRSSQPGVPP

SEQ ID NO: 2209 - protein, 490 aa, Homo sapiens
MEDSDSAAKQLGLAEAAAVAAAAAVAAAAAAAAGGEAEEPVLSRDEDSEEDADSEAERETPRVTAVAVMAAEPGHMDMGAEALPGPDEAAAAAAFAEVTTVTVANVGAAADNVFTTSVANAASISGHVLSGRTALQIGDSLNTEKATLIVVHTDGSIVETTGLKGPAAPLTPGPQSPPTPLAPGQEKGGTKYNWDPSVYDSELPVRCRNISGTLYKNRLGSGWDLKPSRCLLHLCCLLRRHDLITVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEVIHPPRLPKVLGLQQSCVNCGREAMSECTGCHKVNYCSTFCQRKDWKDHQHICGQSAAVTVQADEVHVAESVMEKVTV

SEQ ID NO: 2210 - protein, 491 aa, Homo sapiens
MPSTVLPSTVLPSLLPTAGAGWSMRWILCWSLTLCLMAQTALGALHTKRPQVVTKYGTLQGKQMHVGKTPIQVFLGVPFSRPPLGILRFAPPEPPEPWKGIRDATTYPPGCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRETPMMGICPAGHATTRMKSTCSWILPQEWA

SEQ ID NO: 2211 - protein, 250 aa, Homo sapiens [sequence omitted]

SEQ ID NO: 2212 - protein, 478 aa, Homo sapiens
MSPPLLKLGAVLSTMAMISNWMSQTLPSLVGLNTTRLSTPDTLTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 2213 - protein, 366 aa, Homo sapiens
MARERPPGRGCGVLRRCLLGAVLLFGLRLCAELRRAGPGSPTRSAPPGPAWRPPGPHLPPAPGQPRGASRRQVTYVRSGRRAPPGGGGSGTPEPGCCAPRGRPRRKGPRWHIDLQPWAGSAQSLDEEAWRFLRYISTTQIACNHMNTDSLATDSSPTHKPWSVCLDDRFNLAHQIRNKQCRLYSLGLGSDDTHFEVSMANNGCEVHRFDPSVKSAHILESQHLWYHRLSIDWRDPHPAVAAQKPHSNTRKLGSILNEFGHHKIDVLKADLESAEWKVLENLILEDVLEQIGQLIFEIHLHWPGFEVSGSDSSVVRFWYSLLKELEQKDFRLFHSYKDLSKPQLFLKKDIFNASSCYTLSWVNTRWK

SEQ ID NO: 2214 - protein, 99 aa, Homo sapiens
MKIPVLPAVVLLSLLVLHSAQGATLGGPEEESTIENYASRPEAFNTPFLNIDKLRSAFKADEFLNWHALFESIKRKLPFLNWDAFPKLKGLRSATPDAQ

SEQ ID NO: 2215 - protein, 205 aa, Homo sapiens
MMRTLITTHPLPLLLLPQQLLQLVQFQEVDTDFDFPEEDKKEEFEECLEKFFSTGPARPPTKEKVKRRVLIEPGMPLNHIEYCNHEIMGKNVYYKHRWVAEHYFLLMQYDELQKICYNRFVPCKNGIRKCNRSKGLVEGVYCNLTEAFEIPACKYESLYRKGYVLITCSWQNEMQKRIPHTINDLVEPPEHRSFLSEDGVFVISP

SEQ ID NO: 2216 - protein, 133 aa, Homo sapiens
MLDWRLASAHFILAVTLTLWSSGKVLSVDVTTTEAFDSGVIDVQSTPTVREEKSATDLTAKLLLLDELVSLENDVIETKKKRSFSGFGSPLDRLSAGSVDHKGKQRKVVDHPKRRFGIPMDRIGRNRLSNSRG

SEQ ID NO: 2217 - protein, 281 aa, Homo sapiens
MGSRGQGLLLAYCLLLAFASGLVLSRVPHVQGEQQEWEGTEELPSPPDHAERAEEQHEKYRPSQDQGLPASRCLRCCDPGTSMYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 2218 - protein, 43 aa, Homo sapiens
MKLLYLFLAILLAIEEPVISALVRTVGCCLDTARQTPHPSMHG

SEQ ID NO: 2219 - protein, 286 aa, Homo sapiens
MKVLLLTGLGALFFAYYWDDNFDPASLQGARVLLTGANAGVGEELAYHYARLGSHLVLTAHTEALLQKVVGNCRKLGAPKVFYIAADMASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 2220 - protein, 441 aa, Homo sapiens
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKFKKLKSLDLQQNEISKIESEAFFGLNKLTTLLLQHNQIKVLTEEVFIYTPLLSYLRLYDNPWHCTCEIETLISMLQIPRNRNLGNYAKCESPQEQKNKKLRQIKSEQLCNEEEKEQLDPKPQVSGRPPVIKPEVDSTFCHNYVFPIQTLDCKRKELKKVPNNIPPDIVKLDLSYNKINQLRPKEFEDVHELKKLNLSSNGIEFIDPAAFLGLTHLEELDLSNNSLQNFDYGVLEDLYFLKLLWLRDNPWRCDYNIHYLYYWLKHHYNVHFNGLECKTPEEYKGWSVGKYIRSYYEECPKDKLPAYPESFDQDTEDDEWEKKHRDHTAKKQSVIITIVG

SEQ ID NO: 2221 - protein, 512 aa, Homo sapiens
MAESGLAMWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 2222 - protein, 775 aa, Homo sapiens
MKEGPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 2223 - protein, 476 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 2224 - protein, 636 aa, Homo sapiens
MTTWSLRRRPARTLGLLLLVVLGFLVLRRLDWSTLVPLRLRHRQLGLQAKGWNFMLEDSTFWIFGGSIHYFRVPREYWRDRLLKMKACGLNTLTTYVPWNLHEPERGKFDFSGNLDLEAFVLMAAEIGLWVILRPGPYICSEMDLGGLPSWLLQDPGMRLRTTYKGFTEAVDLYFDHLMSRVVPLQYKRGGPIIAVQVENEYGSYNKDPAYMPYVKKALEDRGIVELLLTSDNKDGLSKGIVQGVLATINLQSTHELQLLTTFLFNVQGTQPKMVMEYWTGWFDSWGGPHNILDSSEVLKTVSAIVDAGSSINLYMFHGGTNFGFMNGAMHFHDYKSDVTSYDYDAVLTEAGDYTAKYMKLRDFFGSISGIPLPPPPDLLPKMPYEPLTPVLYLSLWDALKYLGEPIKSEKPINMENLPVNGGNGQSFGYILYETSITSSGILSGHVHDRGQVFVNTVSIGFLDYKTTKIAVPLIQGYTVLRILVENRGRVNYGENIDDQRKGLIGNLYLNDSPLKNFRIYSLDMKKSFFQRFGLDKWSSLPETPTLPAFFLGSLSISSTPCDTFLKLEGWEKGVVFINGQNLGRYWNIGPQKTLYLPGPWLSSGINQVIVFEETMAGPALQFTETPHLGRNQYIK

SEQ ID NO: 2225 - protein, 223 aa, Homo sapiens [sequence omitted]

SEQ ID NO: 2226 - protein, 455 aa, Homo sapiens
MLHPETSPGRGHLLAVLLALLGTTWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQTAIEAFVCAYSPGGNWEVNGKTIIPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGLVWLSAAMGFGNCVELQASAAFNWNDQRCKTRNRYICQFAQEHISRWGPGS

SEQ ID NO: 2227 - protein, 474 aa, Homo sapiens
MADMQNLVERLERAVGRLEAVSHTSDMHRGYADSPSKGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSCPPPPPPCPPPPPVSTISCSYESASRSSLFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 2228 - protein, 119 aa, Homo sapiens
MNKILSSTVCFGLLTLLSVLSFLQSVHGRPYLTQGNEIFPDKKYTNREELLLALLNKNFDFQRPFNTDLALPNKLEELNQLEKLKEQLVEEKDSETSYAVDGLFSSHPSKRACFWKYCV

SEQ ID NO: 2229 - protein, 1251 aa, Homo sapiens
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHAYPVRCLLPSAHGSCADWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPRHQLQPDGSLVISRVAVEDGGFYTCVAFNGQDRDQRWVQLRVLGELTISGLPPTVTVPEGDTARLLCVVAGESVNIRWSRNGLPVQADGHRVHQSPDGTLLIYNLRARDEGSYTCSAYQGSQAVSRSTEVKVVSPAPTAQPRDPGRDCVDQPELANCDLILQAQLCGNEYYSSFCCASCSRFQPHAQPIWQ

SEQ ID NO: 2230 - protein, 576 aa, Homo sapiens
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYSFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTATVKPRPARSVSKRSRREPPPRTLPATDLQ

SEQ ID NO: 2231 - protein, 281 aa, Homo sapiens
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 2232 - protein, 872 aa, Homo sapiens
MGIVWILMSVLPWWGRCADLAIASTQLVPSTASARMALSSQLMGRTVWTPMSASALQEPAYPALARTSRAPSAASVPLASRCRVTTALISTSAQRSPTSASLAPVPTALGASSASAHLALSSLTMGTVALTHGRVSASPVLRLGSARCPKLSTPPRPAAAAVRGLGRAGETPANCVPRRAVPGPDDSREDVNECAENPGVCTNGVCVNTDGSFRCECPFGYSLDFTGINCVDTDECSVGHPCGQGTCTNVIGGFECACADGFEPGLMMTCEDIDECSLNPLLCAFRCHNTEGSYLCTCPAGYTLREDGAMCRDVDECADGQQDCHARGMECKNLIGTFACVCPPGMRPLPGSGEGCTDDNECHAQPDLCVNGRCVNTAGSFRCDCDEGFQPSPTLTECHDIRQGPCFAEVLQTMCRSLSSSSEAVTRAECCCGGGRGWGPRCELCPLPGTSAYRKLCPHGSGYTAEGRDVDECRMLAHLCAHGECINSLGSFRCHCQAGYTPDATATTCLDMDECSQVPKPCTFLCKNTKGSFLCSCPRGYLLEEDGRTCKDLDECTSRQHNCQFLCVNTVGAFTCRCPPGFTQHHQACFDVNECDGPHRCQHGCQNQLGGYRCSCPQGFTQHSQWAQCVDENECALSPPTCGSASCRNTLGGFRCVCPSGFDFDQALGGCQEVDECAGRRGPCSYSCANTPGGFLCGCPQGYFRAGQGHCVSGLGFSPGPQDTPDKEELLSSEACYECKINGLSPRDRPRRSAHRDHQVNLATLDSEALLTLGLNLSHLGRAERILELRPALEGLEGRIRYVIVRGNEQGFFRMHHLRGVSSLQLGRRRPGPGTYRLEVVSHMAGPWGVQPEGQPGPWGQALRLKVQLQLL

SEQ ID NO: 2233 - protein, 455 aa, Homo sapiens
MARKALKLASWTSMALAASGIYFYSNKYLDPNDFGAVRVGRAVATTAVISYDYLTSLKSVPYGSEEYLQLRSKIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKVPRIHWDLSTERVLLMEFVDGGQVNDRDYMERNKIDVNEISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATEDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 2234 - protein, 414 aa, Homo sapiens
MNPTLGLAIFLAVLLTVKGLLKPSFSPRNYKALSEVQGWKQRMAAKELARQNMDLGFKLLKKLAFYNPGRNIFLSPLSISTAFSMLCLGAQDSTLDEIKQGFNFRKMPEKDLHEGFHYIIHELTQKTQDLKLSIGNTLFIDQRLQPQRKFLEDAKNFYSAETILTNFQNLEMAQKQINDFISQKTHGKINNLIENIDPGTVMLLANYIFFRARWKHEFDPNVTKEEDFFLEKNSSVKVPMMFRSGIYQVGYDDKLSCTILEIPYQKNITAIFILPDEGKLKHLEKGLQVDTFSRWKTLLSRRVVDVSVPRLHMTGTFDLKKTLSYIGVSKIFEEHGDLTKIAPHRSLKVGEAVHKAELKMDERGTEGAAGTGAQTLPMETPLVVKIDKPYLLLIYSEKIPSVLFLGKIVNPIGK

SEQ ID NO: 2235 - protein, 313 aa, Homo sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 2236 - protein, 200 aa, Homo sapiens
MAWGGVHTCCFHLCCCCSWPQGAVPEELHKHPGQTLLLQCQYSPKRGPYQPKSWCQQTSPSRCTLLVTSSKPWTAVQKSHYTIWDKPNAGFFNITMIQLTQNDSGFYWCGIYNASENIITVLRNISLVVSPAPTTSPMWTLPWLPTSTVLITSPEGTSGHPSINGSETRKSRAPACLGSGGPRFLVLVLCGLLLAKGLML

SEQ ID NO: 2237 - protein, 344 aa, Homo sapiens
TTPSRALPGWSNCRPRWRAGPTPQSPTPQSRMRLSPGPPSEWTWLLPHFNPCHHHHRHHHPNPTTSLLPTEPPSGPEVSSQGREASCEGTLRAVDPPVRHHSYGRHEGAWMKDPAARDDRIYVTNYYYGNSLVEFRNLENFKQGRWSNMYKLPYNWIGTGHVVYQGAFYYNRAFTKNIIKYDLRQRFVASWALLPDVVYEDTTPWKWRGHSDIDFAVDESGLWVIYPAVDDRDEAQPEVIVLSRLDPGDLSVHRETTWKTRLRRNSYGNCFLVCGILYAVDTYNQQEGQVAYAFDTHTGTDARPQLPFLNEHAYTTQIDYNPKERVLYAWDNGHQLTYTLHFVV

SEQ ID NO: 2238 - protein, 893 aa, Homo sapiens
MAEAALEAVRSELREFPAAARELCVPLAVPYLDKPPTPLHFYRDWVCPNRPCIIRNALQHWPALQKWSLPYFRATVGSTEVSVAVTPDGYADAVRGDRFMMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQGSGGHPRRRQLGR

SEQ ID NO: 2239 - protein, 117 aa, Homo sapiens
MIIDSSRIPSFTQLHSTMTRAPLLLLCVALVLLGHVNGATVRNEDKWKPLNNPRNRDLFFRRLQAYFKGRGLDLGTFPNPFPTNENPRPLSFQSELTASASADYEEQKNSFHNYLKG

SEQ ID NO: 2240 - protein, 1380 aa, Homo sapiens
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSHVPGNCSENPCQNGGTCVPGADAHSCDCGPGFKGRRCELACIKVSRPCTRLFSETKAFPVWEGGVCHHVYKRVYRVHQDICFKESCESTSLKKTPNRKQSKSQTLEKS

SEQ ID NO: 2241 - protein, 157 aa, Homo sapiens
MEALRRAHEVALRLLLCRPWASRAAARPKPSASEVLTRHLLQRRLPHWTSFCVPYSAVRNDQFGLSHFNWPVQGANYHVLRTGCFPFIKYHCSKAPWQDLARQNRFFTALKVVNLGIPTLLYGLGSWLFARVTETVHTSYGPITVYFLNKEDEGAMY

SEQ ID NO: 2242 - protein, 95 aa, Homo sapiens
MKGSRALLLVALTLFCICRMATGEDNDEFFMDFLQTLLVGTPEELYEGTLGKYNVNEDAKAAMTELKSCIDGLQPMHKAELVKLLVQVLGSQDGA

SEQ ID NO: 2243 - protein, 350 aa, Homo sapiens
MKCSLRVWFLSVAFLLVFIMSLLFTYSHHSMATLPYLDSGALDGTHRVKLVPGYAGLQRLSKERLSGKSCACRRCMGDAGASDWFDSHFDGNISPVWTRENMDLPPDVQRWWMMLQPQFKSHNTNEVLEKLFQIVPGENPYRFRDPHQCRRCAVVGNSGNLRGSGYGQDVDGHNFIMRMNQAPTVGFEQDVGSRTTHHFMYPESAKNLPANVSFVLVPFKVLDLLWIASALSTGQIRFTYAPVKSFLRVDKEKVQIYNPAFFKYIHDRWTEHHGRYPSTGMLVLFFALHVCDEVNVYGFGADSRGNWHHYWENNRYAGEFRKTGVHDADFEAHIIDMLAKASKIEVYRGN

SEQ ID NO: 2244 - protein, 199 aa, Homo sapiens
MASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 2245 - protein, 136 aa, Homo sapiens
MVRPYPLIYFLFLPLGACFPLLDRREPTDAMGGLGAGERWADLAMGPRPHSVWGSSRWLRASQPQALLVIARGLQTSGREHAGCRFRFGRQDEGSEATGFLPAAGEKTSGPLGNLAEELNGYSRKKGGFSFRFGRR

SEQ ID NO: 2246 - protein, 220 aa, Homo sapiens
MRGQGRKESLSDSRDLDGSYDQLTDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 2247 - protein, 724 aa, Homo sapiens
MLRTSTPNLCGGLHCRAPWLSSGILCLCLIFLLGQVGLLQGHPQCLDYGPPFQPPLHLEFCSDYESFGCCDQHKDRRIAARYWDIMEYFDLKRHELCGDYIKDILCQECSPYAAHLYDAENTQTPLRNLPGLCSDYCSAFHSNCHSAISLLTNDRGLQESHGRDGTRFCHLLDLPDKDYCFPNVLRNDYLNRHLGMVAQDPQGCLQLCLSEVANGLRNPVSMVHAGDGTHRFFVAEQVGVVWVYLPDGSRLEQPFLDLKNIVLTTPWIGDERGFLGLAFHPKFRHNRKFYIYYSCLDKKKVEKIRISEMKVSRADPNKADLKSERVILEIEEPASNHNGGQLLFGLDGYMYIFTGDGGQAGDPFGLFGNAQNKSSLLGKVLRIDVNRAGSHGKRYRVPSDNPFVSEPGAHPAIYAYGIRNMWRCAVDRGDPITRQGRGRIFCGDVGQNRFEEVDLILKGGNYGWRAKEGFACYDKKLCHNASLDDVLPIYAYGHAVGKSVTGGYVYRGCESPNLNGLYIFGDFMSGRLMALQEDRKNKKWKKQDLCLGSTTSCAFPGLISTHSKFIISFAEDEAGELYFLATSYPSAYAPRGSIYKFVDPSRRAPPGKCKYKPVPVRTKSKRIPFRPLAKTVLDLLKEQSEKAARKSSSATLASGPAQGLSEKGSSKKLASPTSSKNTLRGPGTKKKARVGPHVRQGKRRKSLKSHSGRMRPSAEQKRAGRSLP

SEQ ID NO: 2248 - protein, 405 aa, Homo sapiens
MWYVSTRGVAPRVNFEGALFSGYAPDGGLFMPEELPQLDRGTLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKWERQDYEKMAVMECDGCCVELCLGNCGPRRGSVTDIPGTAMVRGGG

SEQ ID NO: 2249 - protein, 163 aa, Homo sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGWAEGNLAPHPRSPALQPQQSTAAGLRLSTGPAAAQP

SEQ ID NO: 2250 - protein, 529 aa, Homo sapiens
MAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 2251 - protein, 600 aa, Homo sapiens
MQGPLLLPGLCFLLSLFGAVTQKTKTSCAKCPPNASCVNNTHCTCNHGYTSGSGQKLFTFPLETCNDTTSSKTTEGRKELQKIVDKFESLLTNQTLWRTEGRQEISSTATTILRDVESKVLETALKDPEQKVLKIQNDSVAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 2252 - protein, 219 aa, Homo sapiens
MKLLLWACIVCVAFARKRRFPFIGEDDNDDGHPLHPSLNIPYGIRNLPPPLYYRPVNTVPSYPGNTYTDTGLPSYPWILTSPGFPYVYHIRGFPLATQLNVPPLPPRGFPFVPPSRFFSAAAAPAAPPIAAEPAAAAPLTATPVAAEPAAGAPVAAEPAAEAPVGAEPAAEAPVAAEPAAEAPVGVEPAAEEPSPAEPATAKPAAPEPHPSPSLEQANQ

SEQ ID NO: 2253 - protein, 580 aa, Homo sapiens
MHLSAVFNALLVSVLAAVLWKHVRLREHAATLEEELALSRQATEPAPALRIDYPKALQILMEGGTHMVCTGRTHTDRICRFKWLCYSNEAEEFIFFHGNTSVMLPNLGSRRFQPALLDLSTVEDHNTQYFNFVELPAAALRFMPKPVFVPDVALIANRFNPDNLMHVFHDDLLPLFYTLRQFPGLAHEARLFFMEGWGEGAHFDLYKLLSPKQPLLRAQLKTLGRLLCFSHAFVGLSKITTWYQYGFVQPQGPKANILVSGNEIRQFARFMTEKLNVSHTGVPLGEEYILVFSRTQNRLILNEAELLLALAQEFQMKTVTVSLEDHTFADVVRLVSNASMLVSMHGAQLVTTLFLPRGATVVELFPYAVNPDHYTPYKTLAMLPGMDLQYVAWRNMMPENTVTHPERPWDQGGITHLDRAEQARILQSREVPRHLCCRNPEWLFRIYQDTKVDIPSLIQTIRRVVKGRPGPRKQKWTVGLYPGKVREARCQASVHGASEARLTVSWQIPWNLKYLKVREVKYEVWLQEQGENTYVPYILALQNHTFTENIKPFTTYLVWVRCIFNKILLGPFADVLVCNT

SEQ ID NO: 2254 - protein, 1709 aa, Homo sapiens
MGFLPKLLLLASFFPAGQASWGVSSPQDVQGVKGSCLLIPCIFSFPADVEVPDGITAIWYYDYSGQRQVVSHSADPKLVEARFRGRTEFMGNPEHRVCNLLLKDLQPEDSGSYNFRFEISEVNRWSDVKGTLVTVTEEPRVPTIASPVELLEGTEVDFNCSTPYVCLQEQVRLQWQGQDPARSVTFNSQKFEPTGVGHLETLHMAMSWQDHGRILRCQLSVANHRAQSEIHLQVKYAPKGVKILLSPSGRNILPGELVTLTCQVNSSYPAVSSIKWLKDGVRLQTKTGVLHLPQAAWSDAGVYTCQAENGVGSLVSPPISLHIFMAEVQVSPAGPILENQTVTLVCNTPNEAPSDLRYSWYKNHVLLEDAHSHTLRLHLATRADTGFYFCEVQNVHGSERSGPVSVVVNHPPLTPVLTAFLETQAGLVGILHCSVVSEPLATLVLSHGGHILASTSGDSDHSPRFSGTSGPNSLRLEIRDLEETDSGEYKCSATNSLGNATSTLDFHANAARLLISPAAEVVEGQAVTLSCRSGLSPTPDARFSWYLNGALLHEGPGSSLLLPAASSTDAGSYHCRARDGHSASGPSSPAVLTVLYPPRQPTFTTRLDLDAAGAGAGRRGLLLCRVDSDPPARLQLLHKDRVVATSLPSGGGCSTCGGCSPRMKVTKAPNLLRVEIHNPLLEEEGLYLCEASNALGNASTSATFNGQATVLAIAPSHTLQEGTEANLTCNVSREAAGSPANFSWFRNGVLWAQGPLETVTLLPVARTDAALYACRILTEAGAQLSTPVLLSVLYPPDRPKLSALLDMGQGHMALFICTVDSRPLALLALFHGEHLLATSLGPQVPSHGRFQAKAEANSLKLEVRELGLGDSGSYRCEATNVLGSSNTSLFFQVRGAWVQVSPSPELQEGQAVVLSCQVHTGVPEGTSYRWYRDGQPLQESTSATLRFAAITLTQAGAYHCQAQAPGSATTSLAAPISLHVSYAPRHVTLTTLMDTGPGRLGLLLCRVDSDPPAQLRLLHGDRLVASTLQGVGGPEGSSPRLHVAVAPNTLRLEIHGAMLEDEGVYICEASNTLGQASASADFDAQAVNVQVWPGATVREGQLVNLTCLVWTTHPAQLTYTWYQDGQQRLDAHSIPLPNVTVRDATSYRCGVGPPGRAPRLSRPITLDVLYAPRNLRLTYLLESHGGQLALVLCTVDSRPPAQLALSHAGRLLASSTAASVPNTLRLELRGPQPRDEGFYSCSARSPLGQANTSLELRLEGVRVILAPEAAVPEGAPITVTCADPAAHAPTLYTWYHNGRWLQEGPAASLSFLVATRAHAGAYSCQAQDAQGTRSSRPAALQVLYAPQDAVLSSFRDSRARSMAVIQCTVDSEPPAELALSHDGKVLATSSGVHSLASGTGHVQVARNALRLQVQDVPAGDDTYVCTAQNLLGSISTIGRLQVEGARVVAEPGLDVPEGAALNLSCRLLGGPGPVGNSTFAWFWNDRRLHAEPVPTLAFTHVARAQAGMYHCLAELPTGAAASAPVMLRVLYPPKTPTMMVFVEPEGGLRGILDCRVDSEPLASLTLHLGSRLVASSQPQGAPAEPHIHVLASPNALRVDIEALRPSDQGEYICSASNVLGSASTSTYFGVRALHRLHQFQQLLWVLGLLVGLLLLLLGLGACYTWRRRRVCKQSMGENSVEMAFQKETTQLIDPDAATCETSTCAPPLG

SEQ ID NO: 2255 - protein, 230 aa, Homo sapiens
MCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCLQGFTGQYCDSLYVPCAPSPCVNGGTCRQTGDFTFECNCLPATWPIFPKLLSLQEKESYC

SEQ ID NO: 2256 - protein, 219 aa, Homo sapiens
MFVSYLILTLLHVQTAVLARPGGESIGCDDYLGSDKVVDKCGVCGGDNTGCQVVSGVFKHALTSLGYHRVVEIPEGATKINITEMYKSNKKKSHLKPATRGSQFSSVKVCSVPAACKLLGTPGRARQPVPAPRELEHDKNSPHCAYLSLYLTSLAQSSWRVFSLFSYVLIYLFSKYLAFNTLFALKRMALQRDRKEKTRAWCIFIKLCGREIQILPGPV

SEQ ID NO: 2257 - protein, 120 aa, Homo sapiens
MDNVQPKIKHRPFCFSVKGHVKMLRLALTVTSMTFFIIAQAPEPYIVITGFEVTVILFFILLYVLRLDRLMKWLFWPLLVFALVTAVCCLADGALIYRKLLFNPSGPYQKKPVHEKKEVL

SEQ ID NO: 2258 - protein, 287 aa, Homo sapiens
MAPWSHPSAQLQPVGGDAVSPALMVLLCLGNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGAADNLSPSQNKSDSGTASHLQDYAVENLIRMGMAGLILVVLGILIFQDWHSQRSPQAAAGR

SEQ ID NO: 2259 - protein, 145 aa, Homo sapiens; identical to SEQ ID NO: 1880

SEQ ID NO: 2260 - protein, 591 aa, Homo sapiens
MQQDGLGVGTRNGSGKGRSVHPSWPWCAPRPLRYFGRDARARRAQTAAMALAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 2261 - protein, 225 aa, Homo sapiens
MNRCPRRCRSPLGQAARSLYQLVTGSLSPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 2262 - protein, 234 aa, Homo sapiens
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKNDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 2263 - protein, 799 aa, Homo sapiens
MKPMLKDFSNLLLVVLCDYVLGEAEYLLLREPGHVALSNDTVYVDFQYFDGANGTLRNVSVLLLEANTNQTVTTKYLLTNQSQGTLKFECFYFKEAGDYWFTMTPEATDNSTPFPWWEKSAFLKVEWPVFHVDLNRSAKAAEGTFQVGLFTSQPLCPFPVDKPNIVVDVIFTNSLPEARRNSRQPLEIRTSKRTELAQGQWVEFGCAPLGPEAYVTVVLKLLGRDSVITSTGPIDLAQKFGYKLVMVPELTCESGVEVTVLPPPCTFVQGVVTVFKEAPRYPGKRTIHLAENSLPLGERRTIFNCTLFDMGKNKYCFDFGISSRSHFSAKEECMLIQRNTAFQPSSPSPLQPQGPVKSNNIVTVTGISLCLFIIIATVLITLWRRFGRPAKCSTPARHNSIHSPSFRKNSDEENICELSEQRGSFSDGGDGPTGSPGDTGIPLTYRRSGPVPPEDDASGSESFQSNAQKIIPPLFSYRLAQQQLKEMKKKGLTETTKVYHVSQSPLTDTAIDAAPSAPLDLESPEEAAANKFRIKSPFPEQPAVSAGERPPSRLDLNVTQASCAISPSQTLIRKSQARHVGSRGGPSERSHARNAHFRRTASFHEARQARPFRERSMSTLTPRQAPAYSSRTRTCEQAEDRFRPQSRGAHLFPEKLEHFQEASGTRGPLNPLPKSYTLGQPLRKPDLGDHQAGLVAGIERTEPHRARRGPSPSHKSVSRKQSSPISPKDNYQRVSSLSPSQCRKDKCQSFPTHPEFAFYDNTSFGLTEAEQRMLDLPGYFGSNEEDETTSTLSVEKLVI

SEQ ID NO: 2264 - protein, 308 aa, Homo sapiens
MRLLPEWFLLLFGPWLLRKAVSAQIPESGRPQYLGLRPAAAGAGAPGQQLPEPRSSDGLGVGRAWSWAWPTNHTGALARAGAAGALPAQRTKRKPSIKAARAKKIFGWGDFYFRVHTLKFSLLVTGKIVDHVNGTFSVYFRHNSSSLGNLSVSIVPPSKRVEFGGVWLPGPVPHPLQSTLALEGVLPGLGPPLGMAAAAAGPGLGGSLGGALAGPLGGALGVPGAKESRAFNCHVEYEKTNRARKHRPCLYDPSQVCFTEHTQSQAAWLCAKPFKVICIFVSFLSFDYKLVQKVCPDYNFQSEHPYFG

SEQ ID NO: 2265 - protein, 264 aa, Homo sapiens
MKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 2266 - protein, 453 aa, Homo sapiens
MLRILCLALCSLLTGTRADPGALLRLGMDIMNQVQSAMDESHILEKMAAEAGKKQPGMKPIKGITNLKVKDVQLPVITLNFVPGVGIFQCVSTGMTVTGKSFMGGNMEIIVALNITATNRLLRDEETGLPVFKSEGCEVILVNVKTNLPSNMLPKMVNKFLDSTLHKVLPGLMCPAIDAVLVYVNRKWTNLSDPMPVGQMGTVKYVLMSAPATTASYIQLDFSPVVQQQKGKTIKLADAGEALTFPEGYAKGSSQLLLPATFLSAELALLQKSFHVNIQDTMIGELPPQTTKTLARFIPEVAVAYPKSKPLTTQIKIKKPPKVTMKTGKSLLHLHSTLEMFAARWRSKAPMSLFLLEVHFNLKVQYSVHENQLQMATSLDRLLSLSRKSSSIGNFNERELTGFITSYLEEAYIPVVNDVLQVGLPLPDFLAMNYNLAELDIVENALMLDLKLG

SEQ ID NO: 2267 - protein, 440 aa, Homo sapiens
MSARGRWEGGGRRACRGSLGLARAQGAERVTSSEQRPAMASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDSRSVAQAGVQWRNLGSLQPLPPGFKQFSCLILPSSWDYRSVPPYLANFYIFLVETGFHHVAHAGLELLISRDPPTSGSQSVGL

SEQ ID NO: 2268 - protein, 235 aa, Homo sapiens
MKYVFYLGVLAGTFFFADSSVQKEDPAPYLVYLKSHFNPCVGVLIKPSWVLAPAHCYLPNLKVMLGNFKSRVRDGTEQTINPIQIVRYWNYSHSAPQDDLMLIKLAKPAMLNPKVQPLTLATTNVRPGTVCLLSGLDWSQENSGRHPDLRQNLEAPVMSDRECQKTEQGKSHRNSLCVKFVKVFSRIFGEVAVATVICKDKLQGIEVGHFMGGDVGIYTNVYKYVSWIENTAKDK

SEQ ID NO: 2269 - protein, 141 aa, Homo sapiens
MLKKISVGVAGDLNTVTMKLGCVLMAWALYLSLGVLWVAQMLLGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 2270 - protein, 961 aa, Homo sapiens
MLAPRGAAVLLLHLVLQRWLAAGAQATPQVFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVPPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDSDGDGHQDSTDNCPTVINSAQLDTDKDGIGDECDDDDDNDGIPDLVPPGPDNCRLVPNPAQEDSNSDGVGDICESDFDQDQVIDRIDVCPENAEVTLTDFRAYQTVVLDPEGDAQIDPNWVVLNQGMEIVQTMNSDPGLAVGYTAFNGVDFEGTFHVNTQTDDDYAGFIFGYQDSSSFYVVMWKQTEQTYWQATPFRAVAEPGIQLKAVKSKTGPGEHLRNSLWHTGDTSDQVRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 2271 - protein, 99 aa, Homo sapiens
MDNVQPKIKHRPFCFSVKGHVKMLRLDIINSLVTTVFMLIVSVLALIPETTTLTVGGGVFALVTAVCCLADGALIYRKLLFNPSGPYQKKPVHEKKEVL

SEQ ID NO: 2272 - protein, 135 aa, Homo sapiens
MSPHLTALLGLVLCLAQTIHTQEGALPRPSISAEPGTVISPGSHVTFMCRGPVGVQTFRLEREDRAKYKDSYNVFRLGPSESEARFHIDSVSEGNAGLYRCLYYKPPGWSEHSDFLELLVKGTVPGTEASGFDAP

SEQ ID NO: 2273 - protein, 76 aa, Homo sapiens
MLPCLALLLLMELSVCTVAGDGGEEQTLSTEAETWEGAGPSIQLQLQEVKTGKASQFFGLMGKRVGGREDEAQGSE

SEQ ID NO: 2274 - protein, 227 aa, Homo sapiens
MRGQGRKESLSDSRDLDGSYDQLTDSVDDEFELSTVCHRPEGLEQLQEQTKFTRKELQVLYRGFKNPGALSFQECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 2275 - protein, 291 aa, Homo sapiens
MMSATGPGRKMGSRGQGLLLAYCLLLAFASGLVLSRVPHVQGEQQEWEGTEELPSPPDHAERAEEQHEKYRPSQDQGLPASRCLRCCDPGTSMYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 2276 - protein, 70 aa, Homo sapiens
MERGAGAKLLPLLLLLRATGFTCAQTDGRNGYTAVIEVTSGGPWGDWAWPEMCPDGFFASGFSLKLGRME

SEQ ID NO: 2277 - protein, 133 aa, Homo sapiens
MGSSGLLSLLVLFVLLANVQGPGLTDWLFPRRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKRFP

SEQ ID NO: 2278 - protein, 256 aa, Homo sapiens
MFQTGGLIVFYGLLAQTMAQFGGLPVPLDQTLPLNVNPALPLSPTGLAGSLTNALSNGLLSGGLLGILENLPLLDILKPGGGTSGGLLGGLLGKVTSVIPGLNNIIDIKVTDPQLLELGLVQSPDGHRLYVTIPLGIKLQVNTPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 2279 - protein, 461 aa, Homo sapiens [sequence omitted]

SEQ ID NO: 2280 - protein, 177 aa, Homo sapiens
MRLLILTCLVAVALARPKLPLRYPERLQNPSESSEPIPLESREEYMNGMNRQRNILREKQTDEIKNCVVAEPEKMESSISSSSEEMSLSKCAEQFCRLNEYNQLQLQKMSKQEQIRRMNENSHVQVPFQQLNQLAAYPYAVWYYPQIMQYVPFPPFSDISNPTAHENYEKNNVMLQW

SEQ ID NO: 2281 - protein, 1017 aa, Homo sapiens
MDLIRGVLLRLLLLASSLGPGAVSLRAAIRKPGKVGPPLDIKLGALNCTAFSIQWKMPRHPGSPILGYTVFYSEVGADKSLQEQLHSVPLSRDIPTTEEVIGDLKPGTEYRVSIAAYSQAGKGRLSSPRHVTTLSQDSCLPPAAPQQPHVIVVSDSEVALSWKPGASEGSAPIQYYSVEFIRPDFDKKWTSIHERIQMDSMVIKGLDPDTNYQFAVRAMNSHGPSPRSWPSDIIRTLCPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKECGNYCLNTIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 2282 - protein, 630 aa, Homo sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 2283 - protein, 249 aa, Homo sapiens; identical to SEQ ID NO: 1895

SEQ ID NO: 2284 - protein, 1018 aa, Homo sapiens; identical to SEQ ID NO: 1919

SEQ ID NO: 2285 - protein, 436 aa, Homo sapiens
MQGTPGGGTRPGPSPVDRRTLLVFSFILAAALGQMNFTGDQVLRVLAKDEKQLSLLGDLEGLKPQKVDFWRGPARPSLPVDMRVPFSELKDIKAYLESHGLAYSIMIKDIQVLLDEERQAMAKSRRLERSTNSFSYSSYHTLEEIYSWIDNFVMEHSDIVSKIQIGNSFENQSILVLKFSTGGSRHPAIWIDTGIHSREWITHATGIWTANKIVSDYGKDRVLTDILNAMDIFIELVTNPDGFAFTHSMNRLWRKNKSIRPGIFCIGVDLNRNWKSGFGGNGSNSNPCSETYHGPSPQSEPEVAAIVNFITAHGNFKALISIHSYSQMLMYPYGRLLEPVSNQRELYDLAKDAVEALYKVHGIEYIFGSISTTLYVASGITVDWAYDSGIKYAFSFELRDTGQYGFLLPATQIIPTAQETWMALRTIMEHTLNHPY

SEQ ID NO: 2286 - protein, 163 aa, Homo sapiens [sequence omitted]

SEQ ID NO: 2287 - protein, 70 aa, Homo sapiens; identical to SEQ ID NO: 2185

SEQ ID NO: 2288 - protein, 365 aa, Homo sapiens
MWLLLTMASLISVLGTTHGLFGKLHPGSPEVTMNISQMITYWGYPNEEYEVVTEDGYILEVNRIPYGKKNSGNTDAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 2289 - protein, 844 aa, Homo sapiens
MGPGAPFARVGWPLPLLVVMAAGVAPVWASHSPHLPRPHSRVPPHPSSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 2290 - protein, 339 aa, Homo sapiens
MVSKSRWKLLAMLALVLVVMVWYSISREDRYIELFYFPIPEKKEPCLQGEAESKASKLFGKLSPLCSYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 2291 - protein, 461 aa, Homo sapiens [sequence omitted]

SEQ ID NO: 2292 - protein, 564 aa, Homo sapiens
MAPKKLSCLRSLLLPLSLTLLLPQADTRSFVVDRGHDRFLLDGAPFRYVSGSLHYFRVPRVLWADRLLKMRWSGLNAIQFYVPWNYHEPQPGVYNFNGSRDLIAFLNEAALANLLVILRPGPYICAEWEMGGLPSWLLRKPEIHLRTSDPADNMTKIFTLLRKYEPHGPLVNSEYYTGWLDYWGQNHSTRSVSAVTKGLENMLKLGASVNMYMFHGGTNFGYWNGADKKGRFLPITTSYDYDAPISEAGDPTPKLFALRDVISKFQEVPLGPLPPPSPKMMLGPVTLHLVGHLLAFLDLLCPRGPIHSILPMTFEAVKQDHGFMLYRTYMTHTIFEPTPFWVPNNGVHDRAYVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 2293 - protein, 438 aa, Homo sapiens
MMYAPVEFSEAEFSRAEYQRKQQFWDSVRLALFTLAIVAIIGIAIGIVTHFVVEDDKSFYYLASFKVTNIKYKENYGIRSSREFIERSHQIERMMSRIFRHSSVGGRFIKSHVIKLSPDEQGVDILIVLIFRYPSTDSAEQIKKKIEKALYQSLKTKQLSLTINKPSFRLTPIDSKKMRNLLNSRCGIRMTSSNMPLPASSSTQRIVQGRETAMEGEWPWQASLQLIGSGHQCGASLISNTWLLTAAHCFWKNKDPTQWIATFGATITPPAVKRNVRKIILHENYHRETNENDIALVQLSTGVEFSNIVQRVCLPDSSIKLPPKTSVFVTGFGSIVDDGPIQNTLRQARVETISTDVCNRKDVYDGLITPGMLCAGFMEGKIDACKGDSGGPLVYDNHDIWYIVGIVSWGQSCALPKKPGVYTRVTKYRDWIASKTGM

SEQ ID NO: 2294 - protein, 1463 aa, Homo sapiens
MEPRLFCWTTLFLLAGWCLPGLPCPSRCLCFKSTVRCMHLMLDHIPQVPQQTTVLDLRFNRIREIPGSAFKKLKNLNTLLLNNNHIRKISRNAFEGLENLLYLYLYKNEIHALDKQTFKGLISLEHLYIHFNQLEMLQPETFGDLLRLERLFLHNNKLSKIPAGSFSNLDSLKRLRLDSNALVCDCDLMWLGELLQGFAQHGHTQAAATCEYPRRLHGRAVASVTVEEFNCQSPRITFEPQDVEVPSGNTVYFTCRAEGNPKPEIIWIHNNHSLDLEDDTRLNVFDDGTLMIRNTRESDQGVYQCMARNSAGEAKTQSAMLRYSSLPAKPSFVIQPQDTEVLIGTSTTLECMATGHPHPLITWTRDNGLELDGSRHVATSSGLYLQNITQRDHGRFTCHANNSHGTVQAAANIIVQAPPQFTVTPKDQVVLEEHAVEWLCEADGNPPPVIVWTKTGGQLPVEGQHTVLSSGTLRIDRAAQHDQGQYECQAVSSLGVKKVSVQLTVKPKALAVFTQLPQDTSVEVGKNINISCHAQGEPQPIITWNKEGVQITESGKFHVDDEGTLTIYDAGFPDQGRYECVARNSFGLAVTNMFLTVTAIQGRQAGDDFVESSILDAVQRVDSAINSTRRHLFSQKPHTSSDLLAQFHYPRDPLIVEMARAGEIFEHTLQLIRERVKQGLTVDLEGKEFRYNDLVSPRSLSLIANLSGCTARRPLPNCSNRCFHAKYRAHDGTCNNLQQPTWGAALTAFARLLQPAYRDGIRAPRGLGLPVGSRQPLPPPRLVATVWARAAAVTPDHSYTRMLMHWGWFLEHDLDHTVPALSTARFSDGRPCSSVCTNDPPCFPMNTRHADPRGTHAPCMLFARSSPACASGRPSATVDSVYAREQINQQTAYIDGSNVYGSSERESQALRDPSVPRGLLKTGFPWPPSGKPLLPFSTGPPTECARQEQESPCFLAGDHRANEHLALAAMHTLWFREHNRMATELSALNPHWEGNTVYQEARKIVGAELQHITYSHWLPKVLGDPGTRMLRGYRGYNPNVNAGIINSFATAAFRFGHTLINPILYRLNATLGEISEGHLPFHKALFSPSRIIKEGGIDPVLRGLFGVAAKWRAPSYLLSPELTQRLFSAAYSAAVDSAATIIQRGRDHGIPPYVDFRVFCNLTSVKNFEDLQNEIKDSEIRQKLRKLYGSPGDIDLWPALMVEDLIPGTRVGPTLMCLFVTQFQRLRDGDRFWYENPGVFTPAQLTQLKQASLSRVLCDNGDSIQQVQADVFVKAEYPQDYLNCSEIPKVDLRVWQDCCADCRSRGQFRAVTQESQKKRSAQYSYPVDKDMELSHLRSRQQDKIYVGEDARNVTVLAKTKFSQDFSTFAAEIQETITALREQINKLEARLRQAGCTDVRGVPRKAEERWMKEDCTHCICESGQVTCVVEICPPAPCPSPELVKGTCCPVCRDRGMPSDSPEKR

SEQ ID NO: 2295 - protein, 401 aa, Homo sapiens
MGLKALCLGLLCVLFVSHFYTPMPDNIEESWKIMALDAIAKTCTFTAMCFENMRIMRYEEFISMIFRLDYTQPLSDEYITVTDTTFVDIPVRLYLPKRKSETRRRAVIYFHGGGFCFGSSKQRAFDFLNRWTANTLDAVVVGVDYRLAPQHHFPAQFEDGLAAVKFFLLEKILTKYGVDPTRICIAGDSSGGNLATAVTQQVQNDAEIKHKIKMQVLLYPGLQITDSYLPSHRENEHGIVLTRDVAIKLVSLYFTKDEALPWAMRRNQHMPLESRHLFKFVNWSILLPEKYRKDYVYTEPILGGLSYSLPGLTDSRALPLLANDSQLQNLPLTYILTCQHDLLRDDGLMYVTRLRNVGVQVVHEHIEDGIHGALSFMTSPFYLRLGLRIRDMYVSWLDKNL

SEQ ID NO: 2296 - protein, 87 aa, Homo sapiens; identical to SEQ ID NO: 2125

SEQ ID NO: 2297 - protein, 270 aa, Homo sapiens
MRGQGRKESLSDSRDLDGSYDQLTGHPPGPTKKALKQRFLKLLPCCGPQALPSVSETLAAPASLRPHRPRLLDPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 2298 - protein, 272 aa, Homo sapiens
MHLRLISWLFIILNFMEYIGSQNASRGRRQRRMHPNVSQGCQGGCATCSDYNGCLSCKPRLFFALERIGMKQIGVCLSSCPSGYYGTRYPDINKCTKCKADCDTCFNKNFCTKCKSGFYLHLGKCLDNCPEGLEANNHTMECVSIVHCEVSEWNPWSPCTKKGKTCGFKRGTETRVREIIQHPSAKGNLCPPTNETRKCTVQRKKCQKGERGKKGRERKRKKPNKGESKEAIPDSKSLESSKEIPEQRENKQQQKKRKVQDKQKSVSVSTVH

SEQ ID NO: 2299 - protein, 97 aa, Homo sapiens
MAKSFPVFSLLSFILIHLVLSSVSGPRHWWPPRGIIKVKCPYEKVNLSWYNGTVNPCPGLYQPICGTNFITYDNPCILCVESLKSHGRIRFYHDGKC

SEQ ID NO: 2300 - protein, 241 aa, Homo sapiens; identical to SEQ ID NO: 1987

SEQ ID NO: 2301 - protein, 608 aa, Homo sapiens
MARARAGALLALWVLGAAAHPQCLDFRPPFRPTQPLRLCAQYSDFGCCDEGRDAELTRRFWALASRVDAAEWAACAGYARDLLCQECSPYAAHLYDAEDPFTPLRTVPGLCQDYCLDMWHKCRGLFRHLSTDQELWALEGNLARFCRYLSLDDTDYCFPYLLVNKNLNSNLGHVVADAKGCLQLCLEEVANGLRNPVAMVHARDGTHRFFVAEQVGLVWAYLPDRSRLGKPFLNISRVVLTSPWEGDERGFLGIAFHPSFQHNRRLYVYYSVGIRSSEWIRISEFRVSEDDENAVDHSSERIILEVKEPASNHNGGQLLFGDDGYLYIFTGDGGMAGDPFGTFGNAQNKSALLGKVLRIDVDRKERGLPYGIPPDNPFVGDPAAQPEVYALGVRNMWRCSFDRGDPSSGTGRGRLFCGDVGQNKFEEVDVVERGGNYGWRAREGFECYDRSLCANTSLNDLLPIFAYPHTVGKSVTGGYVYRGCEYPNLNGLYIFGDFMSGRLMSLQENPGTGQWQYSEICMGHGQTCEFPGLINNYYPYIISFGEDEAGELYFMSTGEPSATAPRGVVYKIIDASSCKARSAMPGYVPAPSVCSSLTSQPFILQWWK

SEQ ID NO: 2302 - protein, 116 aa, Homo sapiens
MAPPSVPLVLLLVLLLSLAETPASAPAHRGRGGWTLNSAGYLLGPVLHLPQMGDQDGKRETALEILDLWKAIDGLPYSHPPQPSKRNVMETFAKPEIGDLGMLSMKIPKEEDVLKS

SEQ ID NO: 2303 - protein, 1205 aa, Homo sapiens
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDVDNILIPENRAHLSPEVQLKELLEKLDLVSAMRSSGARTRRVRLLRREINALRQKLAQPPPPQPPSLNKTVSNGELPAGPQGDAAVLEQALQEEPEDDGDRDDSKLPPPPTLEPTGPAPSLSEQESPPEPPTLKPINDSKPPSRFLKPRKVEEDELLEKSPLQLGNEPLQRLLSDNGINRLSLMAPDTPAGTPLSGVGRRTSVLFKKAKNGVKLQRSPDRVLENGEDHGVAGSPASPASIEEERHSRKRPRSRSCSESEGERSPQQEEETGMTNGFGKHTESGSDSECSLGLSGGLAFEACSGLTPPKRSRGKPALSRVPFLEGVNGDSDYNGSGRSLLLPFEDRGDLEPLELVWAKCRGYPSYPALIIDPKMPREGLLHNGVPIPVPPLDVLKLGEQKQAEAGEKLFLVLFFDNKRTWQWLPRDKVLPLGVEDTVDKLKMLEGRKTSIRKSVQVAYDRAMIHLSRVRGPHSFVTSSYL

SEQ ID NO: 2304 - protein, 658 aa, Homo sapiens
MFVSYLILTLLHVQTAVLARPGGESIGCDDYLGSDKVVDKCGVCGGDNTGCQVVSGVFKHALTSLGYHRVVEIPEGATKINITEMYKSNNYLALRSRSGRSIINGNWAIDRPGKYEGGGTMFTYKRPNEISSTAGESFLAEGPTNEILDVYMIHQQPNPGVHYEYVIMGTNAISPQVPPHRRPGEPFNGQMVTEGRSQEEGEQKGRNEEKEDLRGEAPEMFTSESAQTFPVRHPDRFSPHRPDNLVPPAPQPPRRSRDHNWKQLGTTECSTTCGKGSQYPIFRCVHRSTHEEAPESYCDSSMKPTPEEEPCNIFPCPAFWDIGEWSECSKTCGLGMQHRQVLCRQVYANRSLTVQPYRCQHLEKPETTSTCQLKICSEWQIRTDWTSCSVPCGVGQRTRDVKCVSNIGDVVDDEECNMKLRPNDIENCDMGPCAKSWFLTEWSERCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMCSKSCQGGFRVREVRCLSDDMTLSNLCDPQLKPEERESCNPQDCVPEVDENCKDKYYNCNVVVQARLCVYNYYKTACCASCTRVANRQTGFLGSR

SEQ ID NO: 2305 - protein, 235 aa, Homo sapiens
MRPLAGGLLKVVFVVFASLCAWYSGYLLAELIPDAPLSSAAYSIRSIGERPVLKAPVPKRQKCDHWTPCPSDTYAYRLLSGGGRSKYAKICFEDNLLMGEQLGNVARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 2306 - protein, 252 aa, Homo sapiens
MRGQGRKESLSDSRDLDGSYDQLTGHPPGPTKKALKQRFLKLLPCCGPQALPSVSENSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 2307 - protein, 103 aa, Homo sapiens [sequence omitted]

SEQ ID NO: 2308 - protein, 1039 aa, Homo sapiens
MEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVIPQMQKSN

SEQ ID NO: 2309 - protein, 418 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 2310 - protein, 125 aa, Homo sapiens
MQLLKALWALAGAALCCFLVLVIHAQFLKEGQLAAGTCEIVTLDRDSSQPRRTIARQTARCACRKGQIAGTTRARPACVDARIIKTKQWCDMLPCLEGEGCDLLINRSGWTCTQPGGRIKTTTVS

SEQ ID NO: 2311 - protein, 1952 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 2312 - protein, 113 aa, Homo sapiens
MLVLFLLGTVFLLCPYWGELHDPIKATEIMCYECKKYHLGLCYGVMTSCSLKHKQSCAVENFYILTRKGQSMYHYSKLSCMTSCEDINFLGFTKRVELICCDHSNYCNLPEGV

SEQ ID NO: 2313 - protein, 2135 aa, Homo sapiens; identical to SEQ ID NO: 2015

SEQ ID NO: 2314 - protein, 129 aa, Homo sapiens
MRPLKPGAPLPALFLLALALSPHGAHGRPRGRRGARVTDKEPKPLLFLPAAGAGRTPSGSRSAEIFPRDSNLKDKFIKHFTGPVTFSPECSKHFHRLYYNTRECSTPAYYKRCARLLTRLAVSPLCSQT

SEQ ID NO: 2315 - protein, 83 aa, Homo sapiens
MRLSVCLLMVSLALCCYQAHALVCPAVASEITVFLFLSDAAVNLQVAKLNPPPEALAAKLEVKHCTDQISFKKRLSLKKSWWK

SEQ ID NO: 2316 - protein, 484 aa, Homo sapiens; identical to SEQ ID NO: 2124

SEQ ID NO: 2317 - protein, 52 aa, Homo sapiens
MKLCVTVLSLLVLVAAFCSLALSAPSNKPLEASKSALTPVSPGSRSTCMTWN

SEQ ID NO: 2318 - protein, 224 aa, Homo sapiens
MRVSGVLRLLALIFAIVTTWMFIRSYMSFSMKTIRLPRWLAASPTKEIQVKKYKCGLIKPCPANYFAFKICSGAANVVGPTMCFEDRMIMSPVKNNVGRGLNIALVNGTTGAVLGQKAFDMYSGDVMHLVKFLKEIPGGALVLVASYDDPGTKMNDESRKLFSDLGSSYAKQLGFRDSWVFIGAKDLRGKSPFEQFLKNSPDTNKYEGWPELLEMEGCMPPKPF

SEQ ID NO: 2319 - protein, 467 aa, Homo sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 2320 - protein, 78 aa, Homo sapiens
MGSGLPLVLLLTLLGSSHGTGPGMTLQLKLKESFLTNSSYESSFLELLEKLCLLLHLPSGTSVTLHHARSQHHVVCNT

SEQ ID NO: 2321 - protein, 96 aa, Homo sapiens
MEHKEVVLLLLLFLKSGQGEPLDDYVNTQGPSLFSVTKKQLGAGSREECAAKCEEDKEFTCRAFQYHSKEQQCVIMAENRKSSIIIRMRDAVLFEK

SEQ ID NO: 2322 - protein, 360 aa, Homo sapiens
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 2323 - protein, 269 aa, Homo sapiens
MIRTLLLSTLVAGALSCGDPTYPPYVTRVVGGEEARPNSWPWQVSLQYSSNGKWYHTCGGSLIANSWVLTAAHCISSSRTYRVGLGRHNLYVAESGSLAVSVSKIVVHKDWNSNQISKGNDIALLKLANPVSLTDKIQLACLPPAGTILPNNYPCYVTGWGRLQTNGAVPDVLQQGRLLVVDYATCSSSAWWGSSVKTSMICAGGDGVISSCNGDSGGPLNCQASDGRWQVHGIVSFGSRLGCNYYHKPSVFTRVSNYIDWINSVIANN

SEQ ID NO: 2324 - protein, 373 aa, Homo sapiens
MLPWLLVFSALGIQAWGDSSWNKTQAKQVSEGLQYLFENISQLTEKGLPTDVSTTVSRKAWGAEAVGCSIQLTTPVNVLVIHHVPGLECHDQTVCSQRLRELQAHHVHNNSGCDVAYNFLVGDDGRVYEGVGWNIQGVHTQGYNNISLGFAFFGTKKGHSPSPAALSAMENLITYAVQKGHLSSSYVQPLLGKGENCLAPRQKTSLKKACPGVVPRSVWGARETHCPRMTLPAKYGIIIHTAGRTCNISDECRLLVRDIQSFYIDRLKSCDIGYNFLVGQDGAIYEGVGWNVQGSSTPGYDDIALGITFMGTFTGIPPNAAALEAAQDLIQCAMVKGYLTPNYLLVGHSDVARTLSPGQALYNIISTWPHFKH

SEQ ID NO: 2325 - protein, 108 aa, Homo sapiens
MRQRLLPSVTSLLLVALLFPGSSQARHVNHSATEALGELRERAPGQGTNGFQLLRHAVKRDLLPPRTPPYQGDVPPGIRNTICHMQQGICRLFFCHSGTGQQHRQRCG

SEQ ID NO: 2326 - protein, 235 aa, Homo sapiens
MSPPLLKLGAVLSTMAMISNWMSQTLPSLVGLNTTRLSTPDTLTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLIDLKKRKEEEKRQQKGEA

SEQ ID NO: 2327 - protein, 201 aa, Homo sapiens
MNLNCPPCVTGLRVWSSCRSKPNSRARSCRSCTGASRTLPSHHMSHVECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 2328 - protein, 230 aa, Homo sapiens
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 2329 - protein, 227 aa, Homo sapiens
MRVAGAAKLVVAVAVFLLTFYVISQVFEIKMDASLGNLFARSALDTAARSTKPPRYKCGISKACPEKHFAFKMASGAANVVGPKICLEDNVLMSGVKNNVGRGINVALANGKTGEVLDTKYFDMWGGDVAPFIEFLKAIQDGTIVLMGTYDDGATKLNDEARRLIADLGSTSITNLGFRDNWVFCGGKGIKTKSPFEQHIKNNKDTNKYEGWPEVVEMEGCIPQKQD

SEQ ID NO: 2330 - protein, 551 aa, Homo sapiens [sequence omitted]

SEQ ID NO: 2331 - protein, 673 aa, Homo sapiens
MKPGGFWLHLTLLGASLPAALGWMDPGTSRGPDVGVGESQAEEPRSFEVTRREGLSSHNELLASCGKKFCSRGSRCVLSLAPEDRVSVTTVTVGLSTVLTCAVHGDLRPPIIWKRNGLTLNFLDLEDINDFGEDDSLYITKVTTIHMGNYTCHASGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICPQREKNATQPCQWVSAVNVRNRYIYVAQPALSRVLVVDIQAQKVLQSIGVDPLPAKLSYDKSHDQVWVLSWGDVHKSRPSLQVITEASTGQSQHLIRTPFAGVDDFFIPPTNLIINHIRFGFIFNKSDPAVHKVDLETMMPLKTIGLHHHGCVPQAMAHTHLGGYFFIQCRQDSPASAARQLLVDSVTDSVLGPNGDVTGTPHTSPDGRFIVSAAADSPWLHVQEITVRGEIQTLYDLQINSGISDLAFQRSFTESNQYNIYAALHTEPDLLFLELSTGKVGMLKNLKEPPAGPAQPWGGTHRIMRDSGLFGQYLLTPARESLFLINGRQNTLRCEVSGIKGGTTVVWVGEV

SEQ ID NO: 2332 - protein, 668 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGDQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLIVGILLVLMAVVLASLIYRRRLMKQDFSVPQLPHSSSHWLRLPRIFCSCPIGENSPLLSGQQV

SEQ ID NO: 2333 - protein, 581 aa, Homo sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLVYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 2334 - protein, 652 aa, Homo sapiens
MPPPLPLLLLTVLVVAAARPGCEFERNPAGECHRPPAADSATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYILWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 2335 - protein, 92 aa, Homo sapiens
MKLCVTVLSLLVLVAAFCSLALSAPMGSDPPTACCFSYTARKLPRNFVVDYYETSSLCSQPAVVGFLGRKGKQVCADPSESWVQEYVYDLEL

SEQ ID NO: 2336 - protein, 82 aa, Homo sapiens
MRQRLLPSVTSLLLVALLFPGSSQARHVNHSATEALGELRERAPGQGTNGFQLLRHAVKRDLLPPRTPPYQGTGQQHRQRCG

SEQ ID NO: 2337 - protein, 136 aa, Homo sapiens [sequence omitted]

SEQ ID NO: 2338 - protein, 355 aa, Homo sapiens
MQLTTCLRETLFTGASQKTSLWWLGIASFGVPEKLGCANLPLNSRQKELCKRKPYLLPSIREGARLGIQECGSQFRHERWNCMITAAATTAPMGASPLFGYELSSGTKETAFIYAVMAAGLVHSVTRSCSAGNMTECSCDTTLQNGGSASEGWHWGGCSDDVQYGMWFSRKFLDFPIGNTTGKENKVLLAMNLHNNEAGRQAVAKLMSVDCRCHGVSGSCAVKTCWKTMSSFEKIGHLLKDKYENSIQISDKTKRKMRRREKDQRKIPIHKDDLLYVNKSPNYCVEDKKLGIPGTQGRECNRTSEGADGCNLLCCGRGYNTHVVRHVERCECKFIWCCYVRCRRCESMTDVHTCK

SEQ ID NO: 2339 - protein, 971 aa, Homo sapiens
MLRRPAPALAPAARLLLAGLLCGGGVWAARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMETYEDQHSSEEEEEEEEEEESEDGEEEDDITSAESESSEEEEGEQGDPQNATRQQQLEWDDSTLSY

SEQ ID NO: 2340 - protein, 187 aa, Homo sapiens
MVAATVAAAWLLLWAAACAQQEQDFYDFKAVNIRGKLVSLEKYRGSVSLVVNVASECGFTDQHYRALQQLQRDLGPHHFNVLAFPCNQFGQQEPDSNKEIESFARRTYSVSFPMFSKIAVTGTGAHPAFKYLAQTSGKEPTWNFWKYLVAPDGKVVGAWDPTVSVEEVRPQITALVRKLILLKREDL

SEQ ID NO: 2341 - protein, 100 aa, Homo sapiens
MWGFLVLKARWLVTPVRTLATEAGQKPSLRGLLDVGNIQHRAARARGLTRGVIRVSPQERSQQNQSAPKGPTPSTRPKPRTLGPQAHSLALQSVDLLFRP

SEQ ID NO: 2342 - protein, 783 aa, Homo sapiens
MRWQCGTRFRGLRPAVAPWTALLALGLPGWVLAVSATAAAVVPEQHASVAGQHPLDWLLTDRGPFHRAQEYADFMERYRQGFTTRYRIYREFARWKVNNLALERKDFFSLPLPLAPEFIRNIRLLGRRPNLQQVTENLIKKYGTHFLLSATLGGEESLTIFVDKQKLGRKTETTGGASIIGGSGNSTAVSLETLHQLAASYFIDRESTLRRLHHIQIATGAIKVTETRTGPLGCSNYDNLDSVSSVLVQSPENKVQLLGLQVLLPEYLRERFVAAALSYITCSSEGELVCKENDCWCKCSPTFPECNCPDADIQAMEDSLLQIQDSWATHNRQFEESEEFQALLKRLPDDRFLNSTAISQFWAMDTSLQHRYQQLGAGLKVLFKKTHRILRRLFNLCKRCHRQPRFRLPKERSLSYWWNRIQSLLYCGESTFPGTFLEQSHSCTCPYDQSSCQGPIPCALGEGPACAHCAPDNSTRCGSCNPGYVLAQGLCRPEVAESLENFLGLETDLQDLELKYLLQKQDSRIEVHSIFISNDMRLGSWFDPSWRKRMLLTLKSNKYKPGLVHVMLALSLQICLTKNSTLEPVMAIYVNPFGGSHSESWFMPVNEGSFPDWERTNVDAAAQCQNWTITLGNRWKTFFETVHVYLRSRIKSLDDSSNETIYYEPLEMTDPSKNLGYMKINTLQVFGYSLPFDPDAIRDLILQLDYPYTQGSQDSALLQLIELRDRVNQLSPPGKVRLDLFSCLLRHRLKLANNEVGRIQSSLRAFNSKLPNPVEYETGKLCS

SEQ ID NO: 2343 - protein, 671 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 2344 - protein, 124 aa, Homo sapiens
MYKLASCCLLFIGFLNPLLSLPLLDSREISFQLSAPHEDARLTPEELERASLLQILPEMLGAERGDILRKADSSTNIFNPRGNLRKFQDFSGQDPNILLSHLLARIWKPYKKRETPDCFWKYCV

SEQ ID NO: 2345 - protein, 441 aa, Homo sapiens
MEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTPLPVSPMALRCCSPIQPTASFWPLTPVPLEARAPPHPPGPNPPTPRGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHFWGERHRFLH

SEQ ID NO: 2346 - protein, 649 aa, Homo sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 2347 - protein, 133 aa, Homo sapiens
MSERVERNWSTGGWLLALCLAWLWTHLTLAALQPPTATVLVQQGTCEVIAAHRCCNRNRIEERSQTVKCSCFSGQVAGTTRAKPSCVDASIVLQRWWCQMEPCLPGEECKVLPDLSGWSCSSGHKVKTTKVTR

SEQ ID NO: 2348 - protein, 232 aa, Homo sapiens
MVAANTRAPEDTRAPAGPKPSSCEWAVCWAPARCRISATACGNSWDRPAGRTQLLWTPAAPTAMAEVGPGHTPAHPSQGAVPPSRAAAEPHLKPSPSELQTAGPAATIPARLCTRKPRLVYTQCWYVKEPKHPEIVTPWGTAARHSWRQHQMLSASERRCLPRDVEQKLGPEHTGPCLDEQGREAELARSGPSAAGPVRLKPGLVPGLFLLSCTTSPSTCLPVGQEGERGML

SEQ ID NO: 2349 - protein, 236 aa, Homo sapiens
MCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCLQGFTGQYCDSLYVPCAPSPCVNGGTCRQTGDFTFECNCLPETVRRGTELWERDREVWNGKEHDEN

SEQ ID NO: 2350 - protein, 67 aa, Homo sapiens
MDNVQPKIKHRPFCFSVKGHVKMLRLVFALVTAVCCLADGALIYRKLLFNPSGPYQKKPVHEKKEVL

SEQ ID NO: 2351 - protein, 24 aa, Homo sapiens
MLVDGPSERPALCFLLLAVAMSFF

SEQ ID NO: 2352 - protein, 1114 aa, Homo sapiens
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIEQK

SEQ ID NO: 2353 - protein, 723 aa, Homo sapiens
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 2354 - protein, 326 aa, Homo sapiens
MAAPASVMGPLGPSALGLLLLLLVVAPPRVAALVHRQPENQGISLTGSVACGRPSMEGKILGGVPAPERKWPWQVSVHYAGLHVCGGSILNEYWVLSAAHCFHRDKNIKIYDMYVGLVNLRVAGNHTQWYEVNRVILHPTYEMYHPIGGDVALVQLKTRIVFSESVLPVCLATPEVNLTSANCWATGWGLVSKQGETSDELQEMQLPLILEPWCHLLYGHMSYIMPDMLCAGDILNAKTVCEGDSGGPLVCEFNRSWLQIGIVSWGRGCSNPLYPGVYASVSYFSKWICDNIEITPTPAQPAPALSPALGPTLSVLMAMLAGWSVL

SEQ ID NO: 2355 - protein, 531 aa, Homo sapiens
MSLAAYCVICCRRIGTSTSPPKSGTHWRDIRNIIKFTGSLILGGSLFLTYEVLALKKAVTLDTQVVEREKMKSYIYVHTVSLDKGENHGIAWQARKELHKAVRKVLATSAKILRNPFADPFSTVDIEDHECAVWLLLRKSKSDDKTTRLEAVREMSETHHWHDYQYRIIAQACDPKTLIGLARSEESDLRFFLLPPPLPSLKEDSSTEEELRQLLASLPQTELDECIQYFTSLALSESSQSLAAQKGGLWCFGGNGLPYAESFGEVPSATVEMFCLEAIVKHSEISTHCDKIEANGGLQLLQRLYRLHKDCPKVQRNIMRVIGNMALNEHLHSSIVRSGWVSIMAEAMKSPHIMESSHAARILANLDRETVQEKYQDGVYVLHPQYRTSQPIKADVLFIHGLMGAAFKTWRQQDSEQAVIEKPMEDEDRYTTCWPKTWLAKDCPALRIISVEYDTSLSDWRARCPMERRSLLSISSGIVEGLESPLHSEATNFLGSSELLVLGIGQWFGYHIAWEVFLSKRCCWKPLRSQK

SEQ ID NO: 2356 - protein, 531 aa, Homo sapiens; identical to SEQ ID NO: 2355

SEQ ID NO: 2357 - protein, 654 aa, Homo sapiens
MSLAAYCVICCRRIGTSTSPPKSGTHWRDIRNIIKFTGSLILGGSLFLTYEVLALKKAVTLDTQVVEREKMKSYIYVHTVSLDKGENHGIAWQARKELHKAVRKVLATSAKILRNPFADPFSTVDIEDHECAVWLLLRKSKSDDKTTRLEAVREMSETHHWHDYQYRIIAQACDPKTLIGLARSEESDLRFFLLPPPLPSLKEDSSTEEELRQLLASLPQTELDECIQYFTSLALSESSQSLAAQKGGLWCFGGNGLPYAESFGEVPSATVEMFCLEAIVKHSEISTHCDKIEANGGLQLLQRLYRLHKDCPKVQRNIMRVIGNMALNEHLHSSIVRSGWVSIMAEAMKSPHIMESSHAARILANLDRETVQEKYQDGVYVLHPQYRTSQPIKADVLFIHGLMGAAFKTWRQQDSEQAVIEKPMEDEDRYTTCWPKTWLAKDCPALRIISVEYDTSLSDWRARCPMERKSIAFRSNELLRKLRAAGVGDRPVVWISHSMGGLLVKKMLLEASTKPEMSTVINNTRGIIFYSVPHHGSRLAEYSVNIRYLLFPSLEVKELSKDSPALKTLQDDFLEFAKDKNFQVLNFVETLPTYIGSMIKLHVVPVESADLGIGDLIPVDVNHLNICKPKKKDAFLYQRTLQFIREALAKDLEN

SEQ ID NO: 2358 - protein, 502 aa, Homo sapiens
MAQRCVCVLALVAMLLLVFPTVSRSMGPRSGEHQRASRIPSQFSKEERVAMKEALKGAIQIPTVTFSSEKSNTTALAEFGKYIHKVFPTVVSTSFIQHEVVEEYSHLFTIQGSDPSLQPYLLMAHFDVVPAPEEGWEVPPFSGLERDGIIYGRGTLDDKNSVMALLQALELLLIRKYIPRRSFFISLGHDEESSGTGAQRISALLQSRGVQLAFIVDEGGFILDDFIPNFKKPIALIAVSEKGSMNLMLQVNMTSGHSSAPPKETSIGILAAAVSRLEQTPMPIIFGSGTVVTVLQQLANEFPFPVNIILSNPWLFEPLISRFMERNPLTNAIIRTTTALTIFKAGVKFNVIPPVAQATVNFRIHPGQTVQEVLELTKNIVADNRVQFHVLSAFDPLPVSPSDDKALGYQLLRQTVQSVFPEVNITAPVTSIGNTDSRFFTNLTTGIYRFYPIYIQPEDFKRIHGVNEKISVQAYETQVKFIFELIQNADTDQEPVSHLHKL

SEQ ID NO: 2359 - protein, 332 aa, Homo sapiens
MRLLAFLSLLALVLQETGTASLPRKERKRREEQMPREGDSFEVLPLRNDVLNPDNYGEVIDLSNYEELTDYGDQLPEVKVTSLAPATSISPAKSTTAPGTPSSNPTMTRPTTAGLLLSSQPNHGLPTCLVCVCLGSSVYCDDIDLEDIPPLPRRTAYLYARFNRISRIRAEDFKGLTKLKRIDLSNNLISSIDNDAFRLLHALQDLILPENQLEALPVLPSGIEFLDVRLNRLQSSGIQPAAFRAMEKLQFLYLSDNLLDSIPGPLPLSLRSVHLQNNLIETMQRDVFCDPEEHKHTRRQLEDIRLDGNPINLSLFPSAYFCLPRLPIGRFT

SEQ ID NO: 2360 - protein, 466 aa, Homo sapiens
MVRSVAWAGFMVLLMIPWGSAAKLVCYFTNWAQYRQGEARFLPKDLDPSLCTHLIYAFAGMTNHQLSTTEWNDETLYQEFNGLKKMNPKLKTLLAIGGWNFGTQKFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELSLPYLPSGTPELEVPKPGQPSEPEHGPSPGQDTFCQGKADGLYPNPRERSSFYSCAAGRLFQQSCPTGLVFSNSCKCCTWN

SEQ ID NO: 2361 - protein, 531 aa, Homo sapiens
MRLCLGRPHPRGHSRVGKSERGRGARGLARQRTLEDEEEQERERRRRHRNLSSTTDDEAPRLSQNGDRQASASERLPSVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKKGVPEKSPVLEKSSMPKKTAPEKSLVSDKTSISEKVLASEKTSLSEKIAVSEKRNSSEKKSVLEKTSVSEKSLAPGMALGSGRRLVSEKASIFEKALASEKSPTADAKPAPKRATASEQPLAQEPPASGGSPATTKEQRGRALPGKNLPSLAKQGASDPPTVASRLPPVTLQVKIPSKEEEADMSSPTQRTYSSSLKRSSPRTISFRMKPKKENSETTLTRSASMKLPDNTVKLGEKLERYHTAIRRSESVKSRGLPCTELFVAPVGVASKRHLFEKELAGQSRAEPASSRKENLRLSGVVTSRLNLWISRTQESGDQDPQEAQKASSATERTQWGQKSDSSLDAEV

SEQ ID NO: 2362 - protein, 593 aa, Homo sapiens
MKADLKQHHHHWSIFSYIRLRLPSMLLLFSVILISWVSTVGGEGTLCDFPKIHHGFLYDEEDYNPFSQVPTGEVFYYSCEYNFVSPSKSFWTRITCTEEGWSPTPKCLRMCSFPFVKNGHSESSGLIHLEGDTVQIICNTGYSLQNNEKNISCVERGWSTPPICSFTKGECHVPILEANVDAQPKKESYKVGDVLKFSCRKNLIRVGSDSVQCYQFGWSPNFPTCKGQVRSCGPPPQLSNGEVKEIRKEEYGHNEVVEYDCNPNFIINGPKKIQCVDGEWTTLPTCVEQVKTCGYIPELEYGYVQPSVPPYQHGVSVEVNCRNEYAMIGNNMITCINGIWTELPMCVATHQLKRCKIAGVNIKTLLKLSGKEFNHNSRIRYRCSDIFRYRHSVCINGKWNPEVDCTEKREQFCPPPPQIPNAQNMTTTVNYQDGEKVAVLCKENYLLPEAKEIVCKDGRWQSLPRCVESTAYCGPPPSINNGDTTSFPLSVYPPGSTVTYRCQSFYKLQGSVTVTCRNKQWSEPPRCLDPCVVSEENMNKNNIQLKWRNDGKLYAKTGDAVEFQCKFPHKAMISSPPFRAICQEGKFEYPICE

SEQ ID NO: 2363 - protein, 766 aa, Homo sapiens
MIWRSRAGAELFSLMALWEWIALSLHCWVLAVAAVSDQHATSPFDWLLSDKGPFHRSQEYTDFVDRSRQGFSTRYKIYREFGRWKVNNLAVERRNFLGSPLPLAPEFFRNIRLLGRRPTLQQITENLIKKYGTHFLLSATLGGEESLTIFVDKRKLSKRAEGSDSTTNSSSVTLETLHQLAASYFIDRDSTLRRLHHIQIASTAIKVTETRTGPLGCSNYDNLDSVSSVLVQSPENKIQLQGLQVLLPDYLQERFVQAALSYIACNSEGEFICKENDCWCHCGPKFPECNCPSMDIQAMEENLLRITETWKAYNSDFEESDEFKLFMKRLPMNYFLNTSTIMHLWTMDSNFQRRYEQLENSMKQLFLKAQKIVHKLFSLSKRCHKQPLISLPRQRTSTYWLTRIQSFLYCNENGLLGSFSEETHSCTCPNDQVVCTAFLPCTVGDASACLTCAPDNRTRCGTCNTGYMLSQGLCKPEVAESTDHYIGFETDLQDLEMKYLLQKTDRRIEVHAIFISNDMRLNSWFDPSWRKRMLLTLKSNKYKSSLVHMILGLSLQICLTKNSTLEPVLAVYVNPFGGSHSESWFMPVNENSFPDWERTKLDLPLQCYNWTLTLGNKWKTFFETVHIYLRSRIKSNGPNGNESIYYEPLEFIDPSRNLGYMKINNIQVFGYSMHFDPEAIRDLILQLDYPYTQGSQDSALLQLLEIRDRVNKLSPPGQRRLDLFSCLLRHRLKLSTSEVVRIQSALQAFNAKLPNTMDYDTTKLCS

SEQ ID NO: 2364 - protein, 604 aa, Homo sapiens
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPELI

SEQ ID NO: 2365 - protein, 747 aa, Homo sapiens
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 2366 - protein, 491 aa, Homo sapiens; identical to SEQ ID NO: 1866

SEQ ID NO: 2367 - protein, 827 aa, Homo sapiens
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTGITTVLFCFLLRIHGGL

SEQ ID NO: 2368 - protein, 1791 aa, Homo sapiens
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTDDNCTDNFTPNQVARMHCYLDLVYQQWTESRKPTPIPIPPMVIGQTNKSLTIHWLPPISGVVYDRASGSLCGACTEDGTFRQYVHTASSRRVCDSSGYWTPEEAVGPPDVDQPCEPSLQAWSPEVHLYHMNMTVPCPTEGCSLELLFQHPVQADTLTLWVTSFFMESSQVLFDTEILLENKESVHLGPLDTFCDIPLTIKLHVDGKVSGVKVYTFDERIEIDAALLTSQPHSPLCSGCRPVRYQVLRDPPFASGLPVVVTHSHRKFTDVEVTPGQMYQYQVLAEAGGELGEASPPLNHIHGAPYCGDGKVSERLGEECDDGDLVSGDGCSKVCELEEGFNCVGEPSLCYMYEGDGICEPFERKTSIVDCGIYTPKGYLDQWATRAYSSHEDKKKCPVSLVTGEPHSLICTSYHPDLPNHRPLTGWFPCVASENETQDDRSEQPEGSLKKEDEVWLKVCFNRPGEARAIFIFLTTDGLVPGEHQQPTVTLYLTDVRGSNHSLGTYGLSCQHNPLIINVTHHQNVLFHHTTSVLLNFSSPRVGISAVALRTSSRIGLSAPSNCISEDEGQNHQGQSCIHRPCGKQDSCPSLLLDHADVVNCTSIGPGLMKCAITCQRGFALQASSGQYIRPMQKEILLTCSSGHWDQNVSCLPVDCGVPDPSLVNYANFSCSEGTKFLKRCSISCVPPAKLQGLSPWLTCLEDGLWSLPEVYCKLECDAPPIILNANLLLPHCLQDNHDVGTICKYECKPGYYVAESAEGKVRNKLLKIQCLEGGIWEQGSCIPVVCEPPPPVFEGMYECTNGFSLDSQCVLNCNQEREKLPILCTKEGLWTQEFKLCENLQGECPPPPSELNSVEYKCEQGYGIGAVCSPLCVIPPSDPVMLPENITADTLEHWMEPVKVQSIVCTGRRQWHPDPVLVHCIQSCEPFQADGWCDTINNRAYCHYDGGDCCSSTLSSKKVIPFAADCDLDECTCRDPKAEENQ

SEQ ID NO: 2369 - protein, 233 aa, Homo sapiens
MKDPLAKDERIYVTNYYYGNTLVEFRNLENFKQGRWSNSYKLPYSWIGTGHVVYNGAFYYNRAFTRNIIKYDLKQRYVAAWAMLHDVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 2370 - protein, 192 aa, Homo sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 2371 - protein, 152 aa, Homo sapiens
MLLAASFETLQCEGPVCTEESSCHTEDDLTDAREAGFQVKAYTFSEPFHLIVSYGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 2372 - protein, 365 aa, Homo sapiens
MKLGCVLMAWALYLSLGVLWVAQMLLAAGCHAAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 2373 - protein, 236 aa, Homo sapiens
MLKKISVGVAGDLNTVTMKLGCVLMAWALYLSLGVLWVAQMLLELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 2374 - protein, 382 aa, Homo sapiens
MLKKISVGVAGDLNTVTMKLGCVLMAWALYLSLGVLWVAQMLLAAGCHAAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 2375 - protein, 245 aa, Homo sapiens
MSRLRALLGLGLLVAGSRVPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGAGIQKVGWGRLGPYPPDSCPHQV

SEQ ID NO: 2376 - protein, 260 aa, Homo sapiens
MSRLRALLGLGLLVAGSRVPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAELQGRCSGTVPQHPECPEGTHCAHCQHRHSLRMGRGEGKCWRDPARLAHIPHSPQKICNPVYRSLPLPGGSFCATCSGEEVPAEPATLP

SEQ ID NO: 2377 - protein, 288 aa, Homo sapiens
MSRLRALLGLGLLVAGSRVPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGWDVEKGNAGGIQPDLLISLTAPKKSATQFTGRYHYLGGRFVPPALEKKYQLNLPPYPDTECVYRLQ

SEQ ID NO: 2378 - protein, 292 aa, Homo sapiens
MHLRLISWLFIILNFMEYIGSQNASRGRRQRRMHPNVSQGCQGGCATCSDYNGCLSCKPRLFFALERIGMKQIGVCLSSCPSGYYGTRYPDINKCTKCKADCDTCFNKNFCTKCKSGFYLHLGKCLDNCPEGLEANNHTMECVSIVHCEVSEWNPWSPCTKKGKTCGFKRGTETRVREIIQHPSAKGNLCPPTNETRKCTVQRKKCQKGERGKKGRERKRKKPNKGESKEAIPDSKSLESSKEIPEQRENKQQQKKRKVQDKQKSGIEVTLAEGLTSVSQRTQPTPCRRRYL

SEQ ID NO: 2379 - protein, 956 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 2380 - protein, 369 aa, Homo sapiens
MLPWLLVFSALGIQAWGDSSWNKTQAKQVSEGLQYLFENISQLTEKDVSTTVSRKAWGAEAVGCSIQLTTPVNVLVIHHVPGLECHDQTVCSQRLRELQAHHVHNNSGCDVAYNFLVGDDGRVYEGVGWNIQGVHTQGYNNISLGFAFFGTKKGHSPSPAALSAMENLITYAVQKGHLSSSYVQPLLGKGENCLAPRQKTSLKKACPGVVPRSVWGARETHCPRMTLPAKYGIIIHTAGRTCNISDECRLLVRDIQSFYIDRLKSCDIGYNFLVGQDGAIYEGVGWNVQGSSTPGYDDIALGITFMGTFTGIPPNAAALEAAQDLIQCAMVKGYLTPNYLLVGHSDVARTLSPGQALYNIISTWPHFKH

SEQ ID NO: 2381 - protein, 224 aa, Homo sapiens
MEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTGRVSLQKLSLACRRVRCAFALSSSSTMIVRPPQPYGTVPHSSPDPVTTKISPLRNF

SEQ ID NO: 2382 - protein, 94 aa, Homo sapiens
MPVIAGGILAALLLLIVVVLCLYFKIHNALKAAKEPEAVAVKNHNPDKVWWAKNSQAKTIATESCPALQCCEGYRMCASFDSLPPCCCDINEGL

SEQ ID NO: 2383 - protein, 94 aa, Homo sapiens; identical to SEQ ID NO: 2382

SEQ ID NO: 2384 - protein, 341 aa, Homo sapiens
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPSPEDLRLVLMPWGPWHCHCKSGTMSRSRSGKLHGLSGRLRVGALSQLRTEHKPCTYQQCPCNRLREECPLDTSLCTDTNCASQSTTSTRTTTTPFPTIHLRSSPSLPPASPCPALAFWKRVRIGLEDIWNSLSSVFTEMQPIDRNQR

SEQ ID NO: 2385 - protein, 121 aa, Homo sapiens
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPVEEGCYDSLDGSLARGNWKIK

SEQ ID NO: 2386 - protein, 131 aa, Homo sapiens
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPSPDLNDAVSSLRSPIPLLLSCAFVQVGMYFM

SEQ ID NO: 2387 - protein, 131 aa, Homo sapiens; identical to SEQ ID NO: 2386

SEQ ID NO: 2388 - protein, 103 aa, Homo sapiens [sequence omitted]

SEQ ID NO: 2389 - protein, 103 aa, Homo sapiens [sequence omitted]

SEQ ID NO: 2390 - protein, 467 aa, Homo sapiens
MLGIWIVAFLFFGTSRGKEVCYERLGCFKDGLPWTRTFSTELVGLPWSPEKINTRFLLYTIHNPNAYQEISAVNSSTIQASYFGTDKITRINIAGWKTDGKWQRDMCNVLLQLEDINCINLDWINGSREYIHAVNNLRVVGAEVAYFIDVLMKKFEYSPSKVHLIGHSLGAHLAGEAGSRIPGLGRITGLDPAGPFFHNTPKEVRLDPSDANFVDVIHTNAARILFELGVGTIDACGHLDFYPNGGKHMPGCEDLITPLLKFNFNAYKKEMASFFDCNHARSYQFYAESILNPDAFIAYPCRSYTSFKAGNCFFCSKEGCPTMGHFADRFHFKNMKTNGSHYFLNTGSLSPFARWRHKLSVKLSGSEVTQGTVFLRVGGAVRKTGEFAIVSGKLEPGMTYTKLIDADVNVGNITSVQFIWKKHLFEDSQNKLGAEMVINTSGKYGYKSTFCSQDIMGPNILQNLKPC

SEQ ID NO: 2391 - protein, 428 aa, Homo sapiens
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQAHNLPSCPMLKRFARMIEQRAVDTSLYILPKEDRESLQMAVGPFLHILESNLLKAVDSATAPDKIRKLYLYAAHDVTFIPLLMTLGIFDHKWPPFAVDLTMELYQHLESKEWFVQLYYHGKEQVPRGCPDGLCPLDMFLNAMSVYTLSPEKYHALCSQTQVMEVGNEE

SEQ ID NO: 2392 - protein, 236 aa, Homo sapiens; identical to SEQ ID NO: 2349

SEQ ID NO: 2393 - protein, 329 aa, Homo sapiens
MVTKAFVLLAIFAEASAKSCAPNKADVILVFCYPKTIITKIPECPYGWEVHQLALGGLCYNGVHEGGYYQFVIPDLSPKNKSYCGTQSEYKPPIYHFYSHIVSNDTTVIVKNQPVNYSFSCTYHSTYLVNQAAFDQRVATVHVKNGSMGTFESQLSLNFYTNAKFSIKKEAPFVLEASEIGSDLFAGVEAKGLSIRFKVVLNSCWATPSADFMYPLQWQLINKGCPTDETVLVHENGRDHRATFQFNAFRFQNIPKLSKVWLHCETFICDSEKLSCPVTCDKRKRLLRDQTGGVLVVELSLRSRGFSSLYSFSDVLHHLIMMLGICAVL

SEQ ID NO: 2394 - protein, 386 aa, Homo sapiens
MAQWHCSQRTQAGGHGVGERLAQCQDQSSRHAAELRDFKNKMLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQLVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 2395 - protein, 169 aa, Homo sapiens
MSERVERNWSTGGWLLALCLAWLWTHLTLAALQPPTATVLVQQGTCEVIAAHRCCNRNRIEERSQTVKCSCFSGQVAGTTRAKPSCVDDLLLAAHCARRDPRAALRLLLPQPPSSCRDGGVRWSPACRGRSVRCSRTCRDGAAAVDTKSKPPRSHDSSWGSRPGQERLD

SEQ ID NO: 2396 - protein, 230 aa, Homo sapiens; identical to SEQ ID NO: 2328

SEQ ID NO: 2397 - protein, 391 aa, Homo sapiens
MLRPGGAEEAAQLPLRRASAPVPVPSPAAPDGSRASARLGLACLLLLLLLTLPARVDTSWWYIGALGARVICDNIPGLVSRQRQLCQRYPDIMRSVGEGAREWIRECQHQFRHHRWNCTTLDRDHTVFGRVMLRSSREAAFVYAISSAGVVHAITRACSQGELSVCSCDPYTRGRHHDQRGDFDWGGCSDNIHYGVRFAKAFVDAKEKRLKDARALMNLHNNRCGRTAVRRFLKLECKCHGVSGSCTLRTCWRALSDFRRTGDYLRRRYDGAVQVMATQDGANFTAARQGYRRATRTDLVYFDNSPDYCVLDKAAGSLGTAGRVCSKTSKGTDGCEIMCCGRGYDTTRVTRVTQCECKFHWCCAVRCKECRNTVDVHTCKAPKKAEWLDQT

SEQ ID NO: 2398 - protein, 372 aa, Homo sapiens
MLDGLGVVAISIFGIQLKTEGSLRTAVPGIPTQSAFNKCLQRYIGALGARVICDNIPGLVSRQRQLCQRYPDIMRSVGEGAREWIRECQHQFRHHRWNCTTLDRDHTVFGRVMLRSSREAAFVYAISSAGVVHAITRACSQGELSVCSCDPYTRGRHHDQRGDFDWGGCSDNIHYGVRFAKAFVDAKEKRLKDARALMNLHNNRCGRTAVRRFLKLECKCHGVSGSCTLRTCWRALSDFRRTGDYLRRRYDGAVQVMATQDGANFTAARQGYRRATRTDLVYFDNSPDYCVLDKAAGSLGTAGRVCSKTSKGTDGCEIMCCGRGYDTTRVTRVTQCECKFHWCCAVRCKECRNTVDVHTCKAPKKAEWLDQT

SEQ ID NO: 2399 - protein, 413 aa, Homo sapiens
MENMLLWLIFFTPGWTLIDGSEMEWDFMWHLRKVPRIVSERTFHLTSPAFEADAKMMVNTVCGIECQKELPTPSLSELEDYLSYETVFENGTRTLTRVKVQDLVLEPTQNITTKGVSVRRKRQVYGTDSRFSILDKRFLTNFPFSTAVKLSTGCSGILISPQHVLTAAHCVHDGKDYVKGSKKLRVGLLKMRNKSGGKKRRGSKRSRREASGGDQREGTREHLRERAKGGRRRKKSGRGQRIAEGRPSFQWTRVKNTHIPKGWARGGMGDATLDYDYALLELKRAHKKKYMELGISPTIKKMPGGMIHFSGFDNDRADQLVYRFCSVSDESNDLLYQYCDAESGSTGSGVYLRLKDPDKKNWKRKIIAVYSGHQWVDVHGVQKDYNVAVRITPLKYAQICLWIHGNDANCAYG

SEQ ID NO: 2400 - protein, 380 aa, Homo sapiens
MGATTMDQKSLWAGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 2401 - protein, 390 aa, Homo sapiens
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 2402 - protein, 733 aa, Homo sapiens
MAGGRETCLPLIGFILICLKMVASAKSAPEIPTIDQAYSKLSNSITVEWATVPGATSYLLTAEDGDTVIETTVANSPGTVTGLKAATWYEITIRSISAAGRSQASPPKQAKTVLAAPILEVSSPSSDSILVQWEAVYMAIAFSVSIMRANGLGSIWKENTTNTSLTFTSLEAGTLYTIKAYAWNANRIPGDDSTCNQRTSPRAPANIQVSFDSGALKASFSWARAEGAFNYTVMALSDSSELTCSTTFSSCTISSLQCGTEYLISVLASNDAGSSKSSSAMTLKTVACAPGRVTIQEDPPGHLSVAWSSVDLGDYYVVFVKSDDGLEVHCNTSLTQCNFLSECGFTYFISVFVYNKAGQSPLGDIFNYTTAPCCPSDINPVLVSSDRVEIVWSPVRGAELYETKAVDGYNMVECNDTTPACTLSALECDTKYNITVYSFNEVRGSNMSCTPQFITTAPCSPEIKNVSRDAFSMINVHWRSTNDDATYTVTAQGEKGLYQCSSTGESCTMRGLPCGSVFSVTAVAETQAGRSLPSYSVPLETVPCCPTGLTVTQITQSVINVSWTIGRVAQTHVAVLESHTGQSKCHTHQNHCLLGCITCGINYTVTLKAISATGLTADCSYQSYFSGACCPLGVKLYRLGPNGIRIYWQASRGSANYSTDLYGSKGIFTCTPSAGLSFCDVTEIPCGDVYTVMVSPVAKTGLKLTFCPKKIYSVTCSGSTLGMVIYRGKRNEE

SEQ ID NO: 2403 - protein, 184 aa, Homo sapiens
MRGQGRKESLSDSRDLDGSYDQLTDSVDDEFELSTVCHRPEGLEQLQEQTKFTRKELQVLYRGFKNECPSGIVNEENFKQIYSQFFPQGDSSTYATFLFNAFDTNHDGSVSFEEMLDIMKSIYDMMGKYTYPALREEAPREHVESFFQKMDRNKDGVVTIEEFIESCQKDENIMRSMQLFDNVI

SEQ ID NO: 2404 - protein, 252 aa, Homo sapiens [sequence omitted]

SEQ ID NO: 2405 - protein, 458 aa, Homo sapiens
MQATSNLLNLLLLSLFAGLDPSKTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 2406 - protein, 304 aa, Homo sapiens
MLPPPRPAAALALPVLLLLLVVLTPPPTGARPSPGPDYLRRGWMRLLAEGEGCAPCRPEECAAPRGCLAGRVRDACGCCWECANLEGQLCDLDPSAHFYGHCGEQLECRLDTGGDLSRGEVPEPLCACRSQSPLCGSDGHTYSQICRLQEAARARPDANLTVAHPGPCESGPQIVSHPYDTWNVTGQDVIFGCEVFAYPMASIEWRKDGLDIQLPGDDPHISVQFRGGPQRFEVTGWLQIQAVRPSDEGTYRCLGRNALGQVEAPASLTVLTPDQLNSTGIPQLRSLNLVPEEEAESEENDDYY

SEQ ID NO: 2407 - protein, 108 aa, Homo sapiens
MTPSRLPWLLSWVSATAWRAARSPLLCHSLRKTSSSQGGKSELVKQSLKKPKLPEGRFDAPEDSHLEKEPLEKFPDDVNPVTKEKGGPRGPEPTRYGDWERKGRCIDF

SEQ ID NO: 2408 - protein, 220 aa, Homo sapiens
MAGLSRGSARALLAALLASTLLALLVSPARGRGGRDHGDWDEASRLPPLPPREDAARVARFVTHVSDWGALATISTLEAVRGRPFADVLSLSDGPPGAGSGVPYFYLSPLQLSVSNLQENPYATLTMTLAQTNFCKKHGFDPQSPLCVHIMLSGTVTKVNETEMDIAKHSLFIRHPEMKTWPSSHNWFFAKLNITNIWVLDYFGGPKIVTPEEYYNVTVQ

SEQ ID NO: 2409 - protein, 919 aa, Homo sapiens
MGLFRGFVFLLVLCLLHQSNTSFIKLNNNGFEDIVIVIDPSVPEDEKIIEQIEDMVTTASTYLFEATEKRFFFKNVSILIPENWKENPQYKRPKHENHKHADVIVAPPTLPGRDEPYTKQFTECGEKGEYIHFTPDLLLGKKQNEYGPPGKLFVHEWAHLRWGVFDEYNEDQPFYRAKSKKIEATRCSAGISGRNRVYKCQGGSCLSRACRIDSTTKLYGKDCQFFPDKVQTEKASIMFMQSIDSVVEFCNEKTHNQEAPSLQNIKCNFRSTWEVISNSEDFKNTIPMVTPPPPPVFSLLKISQRIVCLVLDKSGSMGGKDRLNRMNQAAKHFLLQTVENGSWVGMVHFDSTATIVNKLIQIKSSDERNTLMAGLPTYPLGGTSICSGIKYAFQVIGELHSQLDGSEVLLLTDGEDNTASSCIDEVKQSGAIVHFIALGRAADEAVIEMSKITGGSHFYVSDEAQNNGLIDAFGALTSGNTDLSQKSLQLESKGLTLNSNAWMNDTVIIDSTVGKDTFFLITWNSLPPSISLWDPSGTIMENFTVDATSKMAYLSIPGTAKVGTWAYNLQAKANPETLTITVTSRAANSSVPPITVNAKMNKDVNSFPSPMIVYAEILQGYVPVLGANVTAFIESQNGHTEVLELLDNGAGADSFKNDGVYSRYFTAYTENGRYSLKVRAHGGANTARLKLRPPLNRAAYIPGWVVNGEIEANPPRPEIDEDTQTTLEDFSRTASGGAFVVSQVPSLPLPDQYPPSQITDLDATVHEDKIILTWTAPGDNFDVGKVQRYIIRISASILDLRDSFDDALQVNTTDLSPKEANSKESFAFKPENISEENATHIFIAIKSIDKSNLTSKVSNIAQVTLFIPQANPDDIDPTPTPTPTPTPDKSHNSGVNISTLVLSVIGSVVIVNFILSTTI

SEQ ID NO: 2410 - protein, 645 aa, Homo sapiens
MAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVAQVAFLGGYSSAASRISEPLSRASYLSLGLGLCLQLYAL

SEQ ID NO: 2411 - protein, 661 aa, Homo sapiens
MAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVGTLGQSPGPRPTTPTAAAATAAAAAAAGAATAAPVLVDGDLNLGSVVKESCEPSC

SEQ ID NO: 2412 - protein, 409 aa, Homo sapiens
MALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLHTGPVTCPHTTGTHSSHCRAFAVAVPHSRNDLEAMFEEEVPRIFYSA

SEQ ID NO: 2413 - protein, 380 aa, Homo sapiens
MALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLVLYGNKITDLPRGVFGGLYTLQLLLLNANKINCIRPDAFQDL

SEQ ID NO: 2414 - protein, 815 aa, Homo sapiens
MALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRICPLSFCSPCRDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQLVILSYNALQCIPPLAFQ

SEQ ID NO: 2415 - protein, 1461 aa, Homo sapiens
MALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQLVDLSNNKISSLSNSSFTNMSQLTTLILSYNALQCIPPLAFQGLRSLRLLSLHGNDISTLQEGIFADVTSLSHLAIGANPLYCDCHLRWLSSWVKTGYKEPGIARCAGPQDMEGKLLLTTPAKKFECQGPPTLAVQAKCDLCLSSPCQNQGTCHNDPLEVYRCACPSGYKGRDCEVSLDSCSSGPCENGGTCHAQEGEDAPFTCSCPTGFEGPTCGVNTDDCVDHACANGGVCVDGVGNYTCQCPLQYEGKACEQLVDLCSPDLNPCQHEAQCVGTPDGPRCECMPGYAGDNCSENQDDCRDHRCQNGAQCMDEVNSYSCLCAEGYSGQLCEIPPHLPAPKSPCEGTECQNGANCVDQGNRPVCQCLPGFGGPECEKLLSVNFVDRDTYLQFTDLQNWPRANITLQVSTAEDNGILLYNGDNDHIAVELYQGHVRVSYDPGSYPSSAIYSAETINDGQFHTVELVAFDQMVNLSIDGGSPMTMDNFGKHYTLNSEAPLYVGGMPVDVNSAAFRLWQILNGTGFHGCIRNLYINNELQDFTKTQMKPGVVPGCEPCRKLYCLHGICQPNATPGPMCHCEAGWVGLHCDQPADGPCHGHKCVHGQCVPLDALSYSCQCQDGYSGALCNQSPSAGGTLSGTFTRSRGAMPSARPRAPCHGWSAGARAQARAAARAFG

SEQ ID NO: 2416 - protein, 189 aa, Homo sapiens
MEATGTDEVDKLKTKFISAWNNMKYSWVLKTKTYFSRNSPVLLLGKCYHFKYEDEDKTLPAESGCTIEDHVIAGNVEEFRKDFISRIWLTYREEFPQIEGSALTTDCGWGCTLRTGQMLLAQGLILHFLGRAWTWPDALNIENSDSESWTSHTVKKFTASFEASLSGEREFKTPTISLKETIGKYSDDH

SEQ ID NO: 2417 - protein, 458 aa, Homo sapiens; identical to SEQ ID NO: 2100

SEQ ID NO: 2418 - protein, 2725 aa, Homo sapiens
MEQTDCKPYQPLPKVKHEMDLAYTSSSDESEDGRKPRQSYNSRETLHEYNQELRMNYNSQSRKRKEVEKSTQEMEFCETSHTLCSGYQTDMHSVSRHGYQLEMGSDVDTETEGAASPDHALRMWIRGMKSEHSSCLSSRANSALSLTDTDHERKSDGENGFKFSPVCCDMEAQAGSTQDVQSSPHNQFTFRPLPPPPPPPHACTCARKPPPAADSLQRRSMTTRSQPSPAAPAPPTSTQDSVHLHNSWVLNSNIPLETRHFLFKHGSGSSAIFSAASQNYPLTSNTVYSPPPRPLPRSTFSRPAFTFNKPYRCCNWKCTALSATAITVTLALLLAYVIAVHLFGLTWQLQPVEGELYANGVSKGNRGTESMDTTYSPIGGKVSDKSEKKVFQKGRAIDTGEVDIGAQVMQTIPPGLFWRFQITIHHPIYLKFNISLAKDSLLGIYGRRNIPPTHTQFDFVKLMDGKQLVKQDSKGSDDTQHSPRNLILTSLQETGFIEYMDQGPWYLAFYNDGKKMEQVFVLTTAIEIMDDCSTNCNGNGECISGHCHCFPGFLGPDCARDSCPVLCGGNGEYEKGHCVCRHGWKGPECDVPEEQCIDPTCFGHGTCIMGVCICVPGYKGEICEEEDCLDPMCSNHGICVKGECHCSTGWGGVNCETPLPVCQEQCSGHGTFLLDAGVCSCDPKWTGSDCSTELCTMECGSHGVCSRGICQCEEGWVGPTCEERSCHSHCTEHGQCKDGKCECSPGWEGDHCTIAHYLDAVRDGCPGLCFGNGRCTLDQNGWHCVCQVGWSGTGCNVVMEMLCGDNLDNDGDGLTDCVDPDCCQQSNCYISPLCQGSPDPLDLIQQSQTLFSQHTSRLFYDRIKFLIGKDSTHVIPPEVSFDSRRACVIRGQVVAIDGTPLVGVNVSFLHHSDYGFTISRQDGSFDLVAIGGISVILIFDRSPFLPEKRTLWLPWNQFIVVEKVTMQRVVSDPPSCDISNFISPNPIVLPSPLTSFGGSCPERGTIVPELQVVQEEIPIPSSFVRLSYLSSRTPGYKTLLRILLTHSTIPVGMIKVHLTVAVEGRLTQKWFPAAINLVYTFAWNKTDIYGQKVWGLAEALVSVGYEYETCPDFILWEQRTVVLQGFEMDASNLGGWSLNKHHILNPQSGIIHKGNGENMFISQQPPVISTIMGNGHQRSVACTNCNGPAHNNKLFAPVALASGPDGSVYVGDFNFVRRIFPSGNSVSILELSTSPAHKYYLAMDPVSESLYLSDTNTRKVYKLKSLVETKDLSKNFEVVAGTGDQCLPFDQSHCGDGGRASEASLNSPRGITVDRHGFIYFVDGTMIRKIDENAVITTVIGSNGLTSTQPLSCDSGMDITQVRLEWPTDLAVNPMDNSLYVLDNNIVLQISENRRVRIIAGRPIHCQVPGIDHFLVSKVAIHSTLESARAISVSHSGLLFIAETDERKVNRIQQVTTNGEIYIIAGAPTDCDCKIDPNCDCFSGDGGYAKDAKMKAPSSLAVSPDGTLYVADLGNVRIRTISRNQAHLNDMNIYEIASPADQELYQFTVNGTHLHTLNLITRDYVYNFTYNSEGDLGAITSSNGNSVHIRRDAGGMPLWLVVPGGQVYWLTISSNGVLKRVSAQGYNLALMTYPGNTGLLATKSNENGWTTVYEYDPEGHLTNATFPTGEVSSFHSDLEKLTKVELDTSNRENVLMSTNLTATSTIYILKQENTQSTYRVNPDGSLRVTFASGMEIGLSSEPHILAGAVNPTLGKCNISLPGEHNANLIEWRQRKEQNKGNVSAFERRLRAHNRNLLSIDFDHITRTGKIYDDHRKFTLRILYDQTGRPILWSPVSRYNEVNITYSPSGLVTFIQRGTWNEKMEYDQSGKIISRTWADGKIWSYTYLEKSVMLLLHSQRRYIFEYDQPDCLLSVTMPSMVRHSLQTMLSVGYYRNIYTPPDSSTSFIQDYSRDGRLLQTLHLGTGRRVLYKYTKQARLSEVLYDTTQVTLTYEESSGVIKTIHLMHDGFICTIRYRQTGPLIGRQIFRFSEEGLVNARFDYSYNNFRVTSMQAVINETPLPIDLYRYVDVSGRTEQFGKFSVINYDLNQVITTTVMKHTKIFSANGQVIEVQYEILKAIAYWMTIQYDNVGRMVICDIRVGVDANITRYFYEYDADGQLQTVSVNDKTQWRYSYDLNGNINLLSHGKSARLTPLRYDLRDRITRLGEIQYKMDEDGFLRQRGNDIFEYNSNGLLQKAYNKASGWTVQYYYDGLGRRVASKSSLGQHLQFFYADLTNPIRVTHLYNHTSSEITSLYYDLQGHLIAMELSSGEEYYVACDNTGTPLAVFSSRGQVIKEILYTPYGDIYHDTYPDFQVIIGFHGGLYDFLTKLVHLGQRDYDVVAGRWTTPNHHIWKQLNLLPKPFNLYSFENNYPVGKIQDVAKYTTDIRSWLELFGFQLHNVLPGFPKPELENLELTYELLRLQTKTQEWDPGKTILGIQCELQKQLRNFISLDQLPMTPRYNDGRCLEGGKQPRFAAVPSVFGKGIKFAIKDGIVTADIIGVANEDSRRLAAILNNAHYLENLHFTIEGRDTHYFIKLGSLEEDLVLIGNTGGRRILENGVNVTVSQMTSVLNGRTRRFADIQLQHGALCFNIRYGTTVEEEKNHVLEIARQRAVAQAWTKEQRRLQEGEEGIRAWTEGEKQQLLSTGRVQGYDGYFVLSVEQYLELSDSANNIHFMRQSEIGRR

SEQ ID NO: 2419 - protein, 67 aa, Homo sapiens
MKIQLFFFILHFWVTILPAKKKYPEYGSLDLRRECRIGNGQCKNQCHENEIRIAYCIRPGTHCCLQQ

SEQ ID NO: 2420 - protein, 276 aa, Homo sapiens
MKQILHPALETTACTNHFNADPCSTGFVFPAMTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYVCQYCPAGNWANRLYVPYEQGAPCASCPDNCDDGLCTNGCKYEDLYSNCKSLKLTLTCKHQLVRDSCKASCNCSNSIY

SEQ ID NO: 2421 - protein, 449 aa, Homo sapiens
MLAEWGACLLLAVALLGPGLQAQAMEGVKCGGVLSAPSGNFSSPNFPRLYPYNTECSWLIVVAEGSSVLLTFHAFDLEYHDTCSFDFLEIYNGASPDKGNLLGRFCGKVPPPPFTSSWHVMSVIFHSDKHVASHGFSAGYQKDVCGGVLTGLSGVLTSPEYPNNYPNSMECHWVIRAAGPAHVKLVFVDFQVEGNEECTYDYVAVLGGPGPTRGHHYCGSTRPPTLVSLGHELQVVFKSDFNIGGRGFKAYYFSGECQEVYMAMRGNFSSPQYPSSYPNNIRCHWTIRLPPGYQVKVFFLDLDLEEPNSLTKTCDFDHLAAFDGASEEAPLLGNWCGHHLPPPVTSSHNQLLLLLHTDRSTTRRGFSVAYIGGQLGCGSGSTEGEGEALQPQSLQSPSSIPPVCPAPPMNGLLQLLLHWLHPCPLSGPLRLDGTAPACFHYCRASFPSF

SEQ ID NO: 2422 - protein, 477 aa, Homo sapiens; identical to SEQ ID NO: 1860

SEQ ID NO: 2423 - protein, 492 aa, Homo sapiens [sequence omitted]

SEQ ID NO: 2424 - protein, 949 aa, Homo sapiens
MILSLLFSLGGPLGWGLLGAWAQASSTSLSDLQSSRTPGVWKAEAEDTGKDPVGRNWCPYPMSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRVGQLRQDVEDRLHAQHFTLHRSISELQADVDTKLKRLHKAQEAPGTNGSLVLATPGAGARPEPDSLQARLGQLQRNLSELHMTTARREEELQYTLEDMRATLTRHVDEIKELYSESDETFDQISKVERQVEELQVNHTALRELRVILMEKSLIMEENKEEVERQLLELNLTLQHLQGGHADLIKYVKDCNCQKLYLDLDVIREGQRDATRALEETQVSLDERRQLDGSSLQALQNAVDAVSLAVDAHKAEGERARAATSRLRSQVQALDDEVGALKAAAAEARHEVRQLHSAFAALLEDALRHEAVLAALFGEEVLEEMSEQTPGPLPLSYEQIRVALQDAASGLQEQALGWDELAARVTALEQASEPPRPAEHLEPSHDAGREEAATTALAGLARELQSLSNDVKNVGRCCEAEAGAGAASLNASLHGLHNALFATQRSLEQHQRLFHSLFGNFQGLMEANVSLDLGKLQTMLSRKGKKQQKDLEAPRKRDKKEAEPLVDIRVTGPVPGALGAALWEAGSPVAFYASFSEGTAALQTVKFNTTYINIGSSYFPEHGYFRAPERGVYLFAVSVEFGPGPGTGQLVFGGHHRTPVCTTGQGSGSTATVFAMAELQKGERVWFELTQGSITKRSLSGTAFGGFLMFKT

SEQ ID NO: 2425 - protein, 81 aa, Homo sapiens
MRLLVLSSLLCILLLCFSIFSTEGKRRPAKAWSGRRTRLCCHRVPSPNSTNLKGHHVRLCKPCKLEPEPRLWVVPGALPQV

SEQ ID NO: 2426 - protein, 229 aa, Homo sapiens
MSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 2427 - protein, 218 aa, Homo sapiens
MGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 2428 - protein, 229 aa, Homo sapiens; identical to SEQ ID NO: 2426

SEQ ID NO: 2429 - protein, 229 aa, Homo sapiens; identical to SEQ ID NO: 2426

SEQ ID NO: 2430 - protein, 415 aa, Homo sapiens; identical to SEQ ID NO: 2138

SEQ ID NO: 2431 - protein, 79 aa, Homo sapiens
MAPQTLLPVLVLCVLLLQAQGGYRDKKRMQKTQLSPEIKVCQQQPKLYLCKHLCESHRDCQANNICCSTYCGNVCMSIL

SEQ ID NO: 2432 - protein, 161 aa, Homo sapiens
MGLSGLLPILVPFILLGDIQEPGHAEGILGKPCPKIKVECEVEEIDQCTKPRDCPENMKCCPFSRGKKCLDFRKIYAVCHRRLAPAWPPYHTGGTIKKTKICSEFIYGGSQGNNNNFQTEAICLVTCKKYHKSALLYTIRRSLNNLQDLAHNPGLSPRVPD

SEQ ID NO: 2433 - protein, 86 aa, Homo sapiens
MGLSGLLPILVPFILLGDIQEPGHAEGILGKPCPKIKVECEVEEIDQCTKPRDCPENMKCCPFSRGKKCLDFRKVSLTLYHKEELE

SEQ ID NO: 2434 - protein, 124 aa, Homo sapiens
MPACRLGPLAAALLLSLLLFGFTLVSGTGAEKTGVCPELQADQNCTQECVSDSECADNLKCCSAGCATFCSLPNDKEGSCPQVNINFPQLGLCRDQCQVDSQCPGQMKCCRNGCGKVSCVTPNF

SEQ ID NO: 2435 - protein, 475 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSCPPPPPPCPPPPPVSTISCSYESASRSSLFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 2436 - protein, 145 aa, Homo sapiens
MADMQNLVERLERAVGRLEAVSHTSDMHRGYADSPSKAGAAPYVQAYIKEFHTTGLAWSKTGPVAKELSGLPSGPSAGSCPPPPPPCPPPPPVSTISCSYESASRSSLFAQINQGESITHALKHVSDDMKTHKNPALKAQSGPVR

SEQ ID NO: 2437 - protein, 475 aa, Homo sapiens; identical to SEQ ID NO: 2435

SEQ ID NO: 2438 - protein, 474 aa, Homo sapiens; identical to SEQ ID NO: 2227

SEQ ID NO: 2439 - protein, 474 aa, Homo sapiens; identical to SEQ ID NO: 2227

SEQ ID NO: 2440 - protein, 475 aa, Homo sapiens; identical to SEQ ID NO: 2435

SEQ ID NO: 2441 - protein, 402 aa, Homo sapiens
MTALPGPLWLLGLALCALGGGGPGLRPPPGCPQRRLGARERRDVQREILAVLGLPGRPRPRAPPAASRLPASAPLFMLDLYHAMAGDDDEDGAPAERRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVHGSHGRQVCRRHELYVSFQDLGWLDWVIAPQGYSAYYCEGECSFPLDSCMNATNHAILQSLVHLMMPDAVPKACCAPTKLSATSVLYYDSSNNVILRKHRNMVVKACGCH

SEQ ID NO: 2442 - protein, 267 aa, Homo sapiens
MAAIRMGKLTTMPAGLIYASVSVHAAKQEESKKQLVKPEQLPIYTAPPLQSKYVEEQPGHLQMGFASIRTATGCYIGWCKGVYVFVKNGIMDTVQFGKDAYVYLKNPPRDFLPKMGVITVSGLAGLVSARKGSKFKKITYPLGLATLGATVCYPVQSVIIAKVTAKRYMLQASKFLEQLNHCGQKAAKKSHSLNLKKTKLGSSSEIEVPAKTTHVLKHSVPLPTELSSEAKTKSESTSGATQFMPDPKLMDHGQSHPEDIDMYSTRS

SEQ ID NO: 2443 - protein, 268 aa, Homo sapiens
MAAIRMGKLTTMPAGLIYASVSVHAAKQEESKKQLVKPEQLPIYTAPPLQSKYVEEQPGHLQMGFASIRTATGCYIGWCKGVYVFVKNGIMDTVQFGKDAYVYLKNPPRDFLPKMGVITVSGLAGLVSARKGSKFKKITYPLGLATLGATVCYPVQSVIIAKVTAKKVYATSQQIFGAVKSLWTKSSKEESLPKPKEKTKLGSSSEIEVPAKTTHVLKHSVPLPTELSSEAKTKSESTSGATQFMPDPKLMDHGQSHPEDIDMYSTRS

SEQ ID NO: 2444 - protein, 1223 aa, Homo sapiens
MAPLRALLSYLLPLHCALCAAAGSRTPELHLSGKLSDYGVTVPCSTDFRGRFLSHVVSGPAAASAGSMVVDTPPTLPRHSSHLRVARSPLHPGGTLWPGRVGRHSLYFNVTVFGKELHLRLRPNRRLVVPGSSVEWQEDFRELFRQPLRQECVYTGGVTGMPGAAVAISNCDGLAGLIRTDSTDFFIEPLERGQQEKEASGRTHVVYRREAVQQEWAEPDGDLHNEAFGLGDLPNLLGLVGDQLGDTERKRRHAKPGSYSIEVLLVVDDSVVRFHGKEHVQNYVLTLMNIVDEIYHDESLGVHINIALVRLIMVGYRQSLSLIERGNPSRSLEQVCRWAHSQQRQDPSHAEHHDHVVFLTRQDFGPSGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAFRTFEPCKQLWCSHPDNPYFCKTKKGPPLDGTECAPGKWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDAQKCELICQSADTGDVVFMNQVVHDGTRCSYRDPYSVCARGECVPVGCDKEVGSMKADDKCGVCGGDNSHCRTVKGTLGKASKQAGALKLVQIPAGARHIQIEALEKSPHRIVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPVT

SEQ ID NO: 2445 - protein, 1226 aa, Homo sapiens
MAPLRALLSYLLPLHCALCAAAGSRTPELHLSGKLSDYGVTVPCSTDFRGRFLSHVVSGPAAASAGSMVVDTPPTLPRHSSHLRVARSPLHPGGTLWPGRVGRHSLYFNVTVFGKELHLRLRPNRRLVVPGSSVEWQEDFRELFRQPLRQECVYTGGVTGMPGAAVAISNCDGLAGLIRTDSTDFFIEPLERGQQEKEASGRTHVVYRREAVQQEWAEPDGDLHNEAFGLGDLPNLLGLVGDQLGDTERKRRHAKPGSYSIEVLLVVDDSVVRFHGKEHVQNYVLTLMNIVDEIYHDESLGVHINIALVRLIMVGYRQSLSLIERGNPSRSLEQVCRWAHSQQRQDPSHAEHHDHVVFLTRQDFGPSGMQGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAFRTFEPCKQLWCSHPDNPYFCKTKKGPPLDGTECAPGKWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDAQKCELICQSADTGDVVFMNQVVHDGTRCSYRDPYSVCARGECVPVGCDKEVGSMKADDKCGVCGGDNSHCRTVKGTLGKASKQAGALKLVQIPAGARHIQIEALEKSPHRIVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPVT

SEQ ID NO: 2446 - protein, 253 aa, Homo sapiens
MAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFIRWGPALQWAQWGGHFSEVQLYSLSLCSQQNPVPHGLSWAFPVPSATLRDDIVIPPG

SEQ ID NO: 2447 - protein, 321 aa, Homo sapiens
MAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFISNTGGKQINQVALEAWRSRRDREEILLQELEPVISRAVLDNPHHGFSNSGIMEERLLDAVVPFLPLQRHHVRHCVLNELAQLGLEPRDEVVQAVLDSTTFFPEDEQLFSSNGCKTVASRIAFFL

SEQ ID NO: 2448 - protein, 191 aa, Homo sapiens
MQVWCDQRHDPGGWTVIQRRLDGSVNFFRNWETYKQGFGNIDGEYWLGLENIYWLTNQGNYKLLVTMEDWSGRKVFAEYASFRLEPESEYYKLRLGRYHGNAGDSFTWHNGKQFTTLDRDHDVYTGNCAHYQKGGWWYNACAHSNLNGVWYRGGHYRSRYQDGVYWAEFRGGSYSLKKVVMMIRPNPNTFH

SEQ ID NO: 2449 - protein, 493 aa, Homo sapiens
MRPLCVTCWWLGLLAAMGAVAGQEDGFEGTEEGSPREFIYLNRYKRAGESQDKCTYTFIVPQQRVTGAICVNSKEPEVLLENRVHKQELELLNNELLKQKRQIETLQQLVEVDGGIVSEVKLLRKESRNMNSRVTQLYMQLLHEIIRKRDNALELSQLENRILNQTADMLQLASKYKDLEHKYQHLATLAHNQSEIIAQLEEHCQRVPSARPVPQPPPAAPPRVYQPPTYNRIINQISTNEIQSDQNLKVLPPPLPTMPTLTSLPSSTDKPSGPWRDCLQALEDGHDTSSIYLVKPENTNRLMQVWCDQRHDPGGWTVIQRRLDGSVNFFRNWETYKQGFGNIDGEYWLGLENIYWLTNQGNYKLLVTMEDWSGRKVFAEYASFRLEPESEYYKLRLGRYHGNAGDSFTWHNGKQFTTLDRDHDVYTGNCAHYQKGGWWYNACAHSNLNGVWYRGGHYRSRYQDGVYWAEFRGGSYSLKKVVMMIRPNPNTFH

SEQ ID NO: 2450 - protein, 652 aa, Homo sapiens
MAAAALPPRPLLLLPLVLLLSGRPTRADSKVFGDLDQVRMTSEGSDCRCKCIMRPLSKDACSRVRSGRARVEDFYTVETVSSGTDCRCSCTAPPSSLNPCENEWKMEKLKKQAPELLKLQSMVDLLEGTLYSMDLMKVHAYVHKVASQMNTLEESIKANLSRENEVVKDSVRHLSEQLRHYENHSAIMLGIKKELSRLGLQLLQKDAAAAPATPATGTGSKAQDTARGKGKDISKYGSVQKSFADRGLPKPPKEKLLQVEKLRKESGKGSFLQPTAKPRALAQQQAVIRGFTYYKAGKQEVTEAVADNTLQGTSWLEQLPPKVEGRSNSAEPNSAEQDEAEPRSSERVDLASGTPTSIPATTTTATTTPTPTTSLLPTEPPSGPEVSSQGREASCEGTLRAVDPPVRHHSYGRHEGAWMKDPAARDDRIYVTNYYYGNSLVEFRNLENFKQGRWSNMYKLPYNWIGTGHVVYQGAFYYNRAFTKNIIKYDLRQRFVASWALLPDVVYEDTTPWKWRGHSDIDFAVDESGLWVIYPAVDDRDEAQPEVIVLSRLDPGDLSVHRETTWKTRLRRNSYGNCFLVCGILYAVDTYNQQEGQVAYAFDTHTGTDARPQLPFLNEHAYTTQIDYNPKERVLYAWDNGHQLTYTLHFVV

SEQ ID NO: 2451 - protein, 546 aa, Homo sapiens
MKNQDKKNGAAKQSNPKSSPGQPEAGPEGAQERPSQAAPAVEAEGPGSSQAPRKPEGAQARTAQSGALRDVSEELSRQLEDILSTYCVDNNQGGPGEDGAQGEPAEPEDAEKSRTYVARNGEPEPTPVVNGEKEPSKGDPNTEEIRQSDEVGDRDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFLLKEAVESQRMCELMKQQETHLKQQLALYTEKFEEFQNTLSKSSEVFTTFKQEMEKMTKKIKKLEKETTMYRSRWESSNKALLEMAEEKTVRDKELEGLQVKIQRLEKLCRALQTERNDLNKRVQDLSAGGQGSLTDSGPERRPEGPGAQAPSSPRVTEAPCYPGAPSTEASGQTGPQEPTSARA

SEQ ID NO: 2452 - protein, 546 aa, Homo sapiens; identical to SEQ ID NO: 2451

SEQ ID NO: 2453 - protein, 463 aa, Homo sapiens
MHGSCSFLMLLLPLLLLLVATTGPVGALTDEEKRLMVELHNLYRAQVSPTASDMLHMRWDEELAAFAKAYARQCVWGHNKERGRRGENLFAITDEGMDVPLAMEEWHHEREHYNLSAATCSPGQMCGHYTQVVWAKTERIGCGSHFCEKLQGVEETNIELLVCNYEPPGNVKGKRPYQEGTPCSQCPSGYHCKNSLCEPIGSPEDAQDLPYLVTEAPSFRATEASDSRKMGTPSSLATGIPAFLVTEVSGSLATKALPAVETQAPTSLATKDPPSMATEAPPCVTTEVPSILAAHSLPSLDEEPVTFPKSTHVPIPKSADKVTDKTKVPSRSPENSLDPKMSLTGARELLPHAQEEAEAEAELPPSSEVLASVFPAQDKPGELQATLDHTGHTSSKSLPNFPNTSATANATGGRALALQSSLPGAEGPDKPSVVSGLNSGPGHVWGPLLGLLLLPPLVLAGIF

SEQ ID NO: 2454 - protein, 152 aa, Homo sapiens
MMLPQWLLLLFLLFFFLFLLTRGSLSPTKYNLLELKESCIRNQDCETGCCQRAPDNCESHCAEKGSEGSLCQTQVFFGQYRACPCLRNLTCIYSKNEKWLSIAYGRCQKIGRQKLAKKMFLVLPPSCCLLLLHLLSSLPRALCSPCSPEPPP

SEQ ID NO: 2455 - protein, 121 aa, Homo sapiens
MMLPQWLLLLFLLFFFLFLLTRGSLSPTKYNLLELKESCIRNQDCETGCCQRAPDNCESHCAEKGSEGSLCQTQVFFGQYRACPCLRNLTCIYSKNEKWLSIAYGRCQKIGRQKLAKKMFF

SEQ ID NO: 2456 - protein, 373 aa, Homo sapiens
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKVRSPAEARGGGWEGLKCITTFPHSQLIHLPLTTEPQEG

SEQ ID NO: 2457 - protein, 269 aa, Homo sapiens
MRLLAWLIFLANWGGARAEPEEAQGPCAQEKGKGPPPTSILASLAPGLEAGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPP

SEQ ID NO: 2458 - protein, 455 aa, Homo sapiens
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKDMVTYFMNLSQANAQGTPRWELEYQLTEAYGVPDASAHSMHTVLDRIAGDQSTLQRYYVYNSVSYSAGVCDEACSMQHVCAMRQVDIDAYTTCLYASGTTPVPQLPLLLMALLGLCTLVL

SEQ ID NO: 2459 - protein, 288 aa, Homo sapiens
MALAPPPRGLWQAKDISPIVKAARRDGELLLSAQLDSEERDPGVPRPSPYAPYILVYANDLAISEPNSVAVTLQRYDPFPAGDPEPRAAPNNSADPRVRRAAQATGPLQDNELPGLDERPPRAHAQHFHKHQLWPSPFRALKPRPGRKDRRKKGQEVFMAASQVLDFDEKTMQKARRKQWDEPRVCSRRYLKVDFADIGWNEWIISPKSFDAYYCAGACEFPMPKIVRPSNHATIQSIVRAVGIIPGIPEPCCVPDKMNSLGVLFLDENRNVVLKVYPNMSVDTCACR

SEQ ID NO: 2460 - protein, 541 aa, Homo sapiens
MPFRLLIPLGLLCALLPQHHGAPGPDGSAPDPAHYSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 2461 - protein, 578 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 2462 - protein, 164 aa, Homo sapiens
MRSCYVAQAGLKLPGSSDPPASASQSTRITASGYGPPSSRPSSRVVNGEDAVPYSWPWQVSLQYEKSGSFYHTCGGSLIAPDWVVTAGHCISSSRTYQVVLGEYDRAVKEGPEQVIPINSGDLFVHPLWNRSCVACGNDIALIKLSRSAQLGDAVQLASLPPAG

SEQ ID NO: 2463 - protein, 1220 aa, Homo sapiens
MPGLLNWITGAALPLTASDVTSCVSGYALGLTASLTYGNLEAQPFQGLFVYPLDECTTVIGFEAVIADRVVTVQIKDKAKLESGHFDASHVRSPTVTGNILQDGVSIAPHSCTPGKVTLDEDLERILFVANLGTIAPMENVTIFISTSSELPTLPSGAVRVLLPAVCAPTVPQFCTKSTGTSNQQAQGKDRHCFGAWAPGSWNKLCLATLLNTEVSNPMEYEFNFQLEIRGPCLLAGVESPTHEIRADAAPSARSAKSIIITLANKHTFDRPVEILIHPSEPHMPHVLIEKGDMTLGEFDQHLKGRTDFIKGMKKKSRAERKTEIIRKRLHKDIPHHSVIMLNFCPDLQSVQPCLRKAHGEFIFLIDRSSSMSGISMHRVKDAMLVALKSLMPACLFNIIGFGSTFKSLFPSSQTYSEDSLAMACDDIQRMKADMGGTNILSPLKWVIRQPVHRGHPRLLFVITDGAVNNTGKVLELVRNHAFSTRCYSFGIGPNVCHRLVKGLASVSEGSAELLMEGERLQPKMVKSLKKAMAPVLSDVTVEWIFPETTEVLVSPVSASSLFPGERLVGYGIVCDASLHISNPRSDKRRRYSMLHSQESGSSVFYHSQDDGPGLEGGDCAKNSGAPFILGQAKNARLASGDSTTKHDLNLSQRRRAYSTNQITNHKPLPRATMASDPMPAAKRYPLRKARLQDLTNQTSLDVQRWQIDLQPLLNSGQDLNQGPKLRGPGARRPSLLPQGCQPFLPWGQETQAWSPVRERTSDSRSPGDLEPSHHPSAFETETSSDWDPPAESQERASPSRPATPAPVLGKALVKGLHDSQRLQWEVSFELGTPGPERGGAQDADLWSETFHHLAARAIIRDFEQLAEREGEIEQGSNRRYQVSALHTSKACNIISKYTAFVPVDVSKSRYLPTVVEYPNSAALRMLGSRALAQQWRGTSSGFGRPQTMLGEDSAPGNGKFQALNMEASPTALFSEARSPGREKHGASEGPQRSLATNTLSSMKASENLFGSWLNLNKSRLLTRAAKGFLSKPLIKAVESTSGNQSFDYIPLVSLQLASGAFLLNEAFCEATHIPMEKLKWTSPFTCHRVSLTTRPSESKTPSPQLCTSSPPRHPSCDSFSLEPLAKGKLGLEPRAVVEHTGKLWATVVGLAWLEHSSASYFTEWELVAAKANSWLEQQEVPEGRTQGTLKAAARQLFVLLRHWDENLEFNMLCYNPNYV

SEQ ID NO: 2464 - protein, 1016 aa, Homo sapiens
MPGLLNWITGAALPLTASDVTSCVSGYALGLTASLTYGNLEAQPFQGLFVYPLDECTTVIGFEAVIADRVVTVQIKDKAKLESGHFDASHVRSPTVTGNILQDGVSIAPHSCTPGKVTLDEDLERILFVANLGTIAPMENVTIFISTSSELPTLPSGAVRVLLPAVCAPTVPQFCTKSTGTSNQQAQGKDRHCFGAWAPGSWNKLCLATLLNTEVSNPMEYEFNFQLEIRGPCLLAGVESPTHEIRADAAPSARSAKSIIITLANKHTFDRPVEILIHPSEPHMPHVLIEKGDMTLGEFDQHLKGRTDFIKGMKKKSRAERKTEIIRKRLHKDIPHHSVIMLNFCPDLQSVQPCLRKAHGEFIFLIDRSSSMSGISMHRVKDAMLVALKSLMPACLFNIIGFGSTFKSLFPSSQTYSEDSLAMACDDIQRMKADMGGTNILSPLKWVIRQPVHRGHPRLLFVITDGAVNNTGKVLELVRNHAFSTRCYSFGIGPNVCHRLVKGLASVSEGSAELLMEGERLQPKMVKSLKKAMAPVLSDVTVEWIFPETTEVLVSPVSASSLFPGERLVGYGIVCDASLHISNPRSDKRRRYSMLHSQESGSSVFYHSQDDGPGLEGGDCAKNSGAPFILGQAKNARLASGDSTTKHDLNLSQRRRAYSTNQITNHKPLPRATMASDPMPAAKRYPLRKARLQDLTNQTSLDVQRWQIDLQPLLNSGQDLNQGPKLRGPGARRPSLLPQGCQPFLPWGQETQAWSPVRERTSDSRSPGDLEPSHHPSAFETETSSDWDPPAESQERASPSRPATPAPVLGKALVKGLHDSQRLQWEVSFELGTPGPERGGAQDADLWSETFHHLAARAIIRDFEQLAEREGEIEQGSNRRYQVSALHTSKACNIISKYTAFVPVDVSKSRYLPTVVEYPNSAALRMLGSRALAQQWRGTSSGFGRPQTMLGEDSAPGNGPRKCSQTLMGFKTKTETEHSVRGWKPRGALQNQSVLSTSWSHWPPKPRRTSSTPEPS

SEQ ID NO: 2465 - protein, 1220 aa, Homo sapiens; identical to SEQ ID NO: 2463

SEQ ID NO: 2466 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 2467 - protein, 413 aa, Homo sapiens
MKGALGSPVAAAGAAMQESFGCVVANRFHQLLDDESDPFDILREAERRRQQQLQRKRRDEAAAAAGAGPRGGRSPAGASGHRAGAGGRRESQKERKSLPAPVAQRPDSPGGGLQAPGQKRTPRRGEQQGWNDSRGPEGMLERAERRSYREYRPYETERQADFTAEKFPDEKPGDRFDRDRPLRGRGGPRGGMRGRGRGGPGNRVFDAFDQRGKREFERYGGNDKIAVRTEDNMGGCGVRTWGSGKDTSDVEPTAPMEEPTVVEESQGTPEEESPAKVPELEVEEETQVQEMTLDEWKNLQEQTRPKPEFNIRKPESTVPSKAVVIHKSKYRDDMVKDDYEDDSHVFRKPANDITSQLEINFGNLPRPGRGARGGTRGGRGRIRRAENYGPRAEVVMQDVAPNPDDPEDFPALS

SEQ ID NO: 2468 - protein, 308 aa, Homo sapiens
MKGALGSPVAAAGAAMQESFGCVVANRFHQLLDDESDPFDILREAERRRQQQLQRKRRDEAAAAAGAGPRGGRSPAGASGHRAGAGGRRESQKERKSLPAPVAQRPDSPGGGLQAPGQKRTPRRGEQQGWNDSRGPEGMLERAERRSYREYRPYETERQADFTAEKFPDEKVPELEVEEETQVQEMTLDEWKNLQEQTRPKPEFNIRKPESTVPSKAVVIHKSKYRDDMVKDDYEDDSHVFRKPANDITSQLEINFGNLPRPGRGARGGTRGGRGRIRRAENYGPRAEVVMQDVAPNPDDPEDFPALS

SEQ ID NO: 2469 - protein, 478 aa, Homo sapiens
MPRRGYSKPGSWGSFWAMLTLVGLVTHAAQRADVGGEAAGTSINHSQAVLQRLQELLRQGNASDVVLRVQAAGTDEVRVFHAHRLLLGLHSELFLELLSNQSEAVLQEPQDCAAVFDKFIRYLYCGELTVLLTQAIPLHRLATKYGVSSLQRGVADYMRAHLAGGAGPAVGWYHYAVGTGDEALRESCLQFLAWNLSAVAASTEWGAVSPELLWQLLQRSDLVLQDELELFHALEAWLGRARPPPAVAERALRAIRYPMIPPAQLFQLQARSAALARHGPAVADLLLQAYQFHAASPLHYAKFFDVNGSAFLPRNYLAPAWGAPWVINNPARDDRSTSFQTQLGPSGHDAGRRVTWNVLFSPRWLPVSLRPVYADAAGTALPAARPEDGRPRLVVTPASSGGDAAGVSFQKTVLVGARQQGRLLVRHAYSFHQSSEEAGDFLAHADLQRRNSEYLVENALHLHLIVKPVYHTLIRTPK

SEQ ID NO: 2470 - protein, 158 aa, Homo sapiens
MCCPGGHYTLILRRGNRFRREKRPAKVTGAQTEVQLAPPLPRGRARRSPWSVPISLSIDRLEFDLLYPAIKGDTIQLYLGAKLLDSQGKVTKWFNNSAASLTMPTLDNIPFSLIVSQDVVKAAVAAVLSPEEFMVLLDSVLPESAHRLKSSIGLINEK

SEQ ID NO: 2471 - protein, 256 aa, Homo sapiens; identical to SEQ ID NO: 2278

SEQ ID NO: 2472 - protein, 256 aa, Homo sapiens; identical to SEQ ID NO: 2278

SEQ ID NO: 2473 - protein, 218 aa, Homo sapiens
MMCPLWRLLIFLGLLALPLAPHKQPWPGLAQAHRDNKSTLARIIAQGLIKHNAESRIQNIHFGDRLNASAQVAPGLVGWLISGRKHQQQQESRSFDNNIVKMCAHMSIVVEFWLEKDEFGRRDLVIGKCDAEPSSVHVAILTEAIPPKMNQFLYNLKENLQKVLPHMVESQVCPLIGEILGQLDVKLLKSLIEQEAAHEPTHHETSQPSACQAGESPS

SEQ ID NO: 2474 - protein, 254 aa, Homo sapiens
MMCPLWRLLIFLGLLALPLAPHKQPWPGLAQAHRDNKSTLARIIAQGLIKHNAESRIQNIHFGDRLNASAQVAPGLVGWLISGRKHQQQQESSINITNIQLDCGGIQISFHKEWFSANISLEFDLELRPSFDNNIVKMCAHMSIVVEFWLEKDEFGRRDLVIGKCDAEPSSVHVAILTEAIPPKMNQFLYNLKENLQKVLPHMVESQVCPLIGEILGQLDVKLLKSLIEQEAAHEPTHHETSQPSACQAGESPS

SEQ ID NO: 2475 - protein, 544 aa, Homo sapiens
MKISMINYKSLLALLFILASWIIFTVFQNSTKVWSALNLSISLHYWNNSTKSLFPKTPLISLKPLTETELRIKEIIEKLDQQIPPRPFTHVNTTTSATHSTATILNPRDTYCRGDQLHILLEVRDHLGRRKQYGGDFLRARMSSPALMAGASGKVTDFNNGTYLVSFTLFWEGQVSLSLLLIHPSEGVSALWSARNQGYDRVIFTGQFVNGTSQVHSECGLILNTNAELCQYLDNRDQEGFYCVRPQHMPCAALTHMYSKNKKVSYLSKQEKSLFERSNVGVEIMEKFNTISVSKCNKETVAMKEKCKFGMTSTIPSGHVWRNTWNPVSCSLATVKMKECLRGKLIYLMGDSTIRQWMEYFKASINTLKSVDLHESGKLQHQLAVDLDRNINIQWQKYCYPLIGSMTYSVKEMEYLTRAIDRTGGEKNTVIVISLGQHFRPFPIDVFIRRALNVHKAIQHLLLRSPDTMVIIKTENIREMYNDAERFSDFHGYIQYLIIKDIFQDLSVSIIDAWDITIAYGTNNVHPPQHVVGNQINILLNYIC

SEQ ID NO: 2476 - protein, 614 aa, Homo sapiens
MWMAWCVAALSVVAVCGTSHETNTVLRVTKDVLSNAISGMLQQSDALHSALREVPLGVGDIPYNDFHVRGPPPVYTNGKKLDGIYQYGHIETNDNTAQLGGKYRYGEILESEGSIRDLRNSGYRSAENAYGGHRGLGRYRAAPVGRLHRRELQPGEIPPGVATGAVGPGGLLGTGGMLAADGILAGQGGLLGGGGLLGDGGLLGGGGVLGVLGEGGILSTVQGITGLRIVELTLPRVSVRLLPGVGVYLSLYTRVAINGKSLIGFLDIAVEVNITAKVRLTMDRTGYPRLVIERCDTLLGGIKVKLLRGLLPNLVDNLVNRVLADVLPDLLCPIVDVVLGLVNDQLGLVDSLIPLGILGSVQYTFSSLPLVTGEFLELDLNTLVGEAGGGLIDYPLGWPAVSPKPMPELPPMGDNTKSQLAMSANFLGSVLTLLQKQHALDLDITNGMFEELPPLTTATLGALIPKVFQQYPESCPLIIRIQVLNPPSVMLQKDKALVKVLATAEVMVSQPKDLETTICLIDVDTEFLASFSTEGDKLMIDAKLEKTSLNLRTSNVGNFDIGLMEVLVEKIFDLAFMPAMNAVLGSGVPLPKILNIDFSNADIDVLEDLLVLSA

SEQ ID NO: 2477 - protein, 476 aa, Homo sapiens
MQPVMLALWSLLLLWGLATPCQELLETVGTLARIDKDELGKAIQNSLVGEPILQNVLGSVTAVNRGLLGSGGLLGGGGLLGHGGVFGVVEELSGLKIEELTLPKVLLKLLPGFGVQLSLHTKVGMHCSGPLGGLLQLAAEVNVTSRVALAVSSRGTPILILKRCSTLLGHISLFSGLLPTPLFGVVEQMLFKVLPGLLCPVVDSVLGVVNELLGAVLGLVSLGALGSVEFSLATLPLISNQYIELDINPIVKSVAGDIIDFPKSRAPAKVPPKKDHTSQVMVPLYLFNTTFGLLQTNGALDMDITPELVPSDVPLTTTDLAALLPEALGKLPLHQQLLLFLRVREAPTVTLHNKKALVSLPANIHVLFYVPKGTPESLFELNSVMTVRAQLAPSATKLHISLSLERLSVKVASSFTHAFDGSRLEEWLSHVVGAVYAPKLNVALDVGIPLPKVLNINFSNSVLEIVENAVVLTVAS

SEQ ID NO: 2478 - protein, 194 aa, Homo sapiens
MQDAPLSCLSPTKWSSVSSADSTEKSASGAGTRNLPFQFCLRQALRMKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALITDDLTDAIICARKIVKETQGMNYWQGWKKHCEGRDLSEWKKGCEVS

SEQ ID NO: 2479 - protein, 421 aa, Homo sapiens
MGFLSPIYVIFFFFGVKVHCQYETYQWDEDYDQEPDDDYQTGFPFRQNVDYGVPFHQYTLGCVSECFCPTNFPSSMYCDNRKLKTIPNIPMHIQQLYLQFNEIEAVTANSFINATHLKEINLSHNKIKSQKIDYGVFAKLPNLLQLHLEHNNLEEFPFPLPKSLERLLLGYNEISKLQTNAMDGLVNLTMLDLCYNYLHDSLLKDKIFAKMEKLMQLNLCSNRLESMPPGLPSSLMYLSLENNSISSIPEKYFDKLPKLHTLRMSHNKLQDIPYNIFNLPNIVELSVGHNKLKQAFYIPRNLEHLYLQNNEIEKMNLTVMCPSIDPLHYHHLTYIRVDQNKLKEPISSYIFFCFPHIHTIYYGEQRSTNGQTIQLKTQVFRRFPDDDDESEDHDDPDNAHESPEQEGAEGHFDLHYYENQE

SEQ ID NO: 2480 - protein, 83 aa, Homo sapiens
MLCCCPLADALLIFLETGSCFQPGQQSETLSQKQNKTNNKKWAGGAGCRPFRLWWVGRSRGAGVQLYSTKKGWILRGKGGTEA

SEQ ID NO: 2481 - protein, 852 aa, Homo sapiens
MLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVEVTGLGSRANPGDPQPHFSHVILRGVPEGAELGQVPLEPVGPPERGLLAASLSPTLLSTPRPFSLELIGQDAAGRRLHRAAPQPSTVVPVLLELSGPSGFLAPGSKVPLSLRIASFSGPQDLDLRTFVNPSFSLTSNLSRAHLELNESAWGRLWLEVPDSAAPDSVVMVTVTAGGREANPVPPTHAFLRLLVSAPAPQVRNHYFPSQGPAHHPYRLI

SEQ ID NO: 2482 - protein, 891 aa, Homo sapiens
MLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVEVTGLGSRANPGDPQPHFSHVILRGVPEGAELGQVPLEPVGPPERGLLAASLSPTLLSTPRPFSLELIGQDAAGRRLHRAAPQPSTVVPVLLELSGPSGFLAPGSKVPLSLRIASFSGPQDLDLRTFVNPSFSLTSNLSRAHLELNESAWGRLWLEVPDSAAPDSVVMVTVTAGGREANPVPPTHAFLRLLVSAPAPQDRHTTPTGSSDPILTTATPAFSPFTLVTQGRAGAGLAAGSPWWGTVGGVLLLLGLASW

SEQ ID NO: 2483 - protein, 183 aa, Homo sapiens
MVRIWTTIMIVLILLLRIGPNKPSLSGRQAPAQAQTSDLVPSLFPLGLWAPGFCTWSSPDEDKRPRKPVPGTGNRDSGTRRRLQDATEQDPRPGNDVASAETAGPPSPSGIRAQDRAPRHRRAPPARMPVAPAPSADGEPLQEQGGGLFHRTRSVYNGLELNTWMKVERLFVEKFHQSFSLDN

SEQ ID NO: 2484 - protein, 147 aa, Homo sapiens
MAGPAGSQSLGPLCFHSSPQALYTVLLIVLVMMSLVFGKFVPVNWEPPQPLPFPKYLRCYRCLLETKELGCLLGSDICLTPAGSSCITLHKKNSSGSDVMVSDCRSKEQMSDCSNTRTSPVSGFWIFSQYCFLDFCNDPQNRGLYTP

SEQ ID NO: 2485 - protein, 148 aa, Homo sapiens
MQTFPVAGALDPAILDTSSPQALYTVLLIVLVMMSLVFGKFVPVNWEPPQPLPFPKYLRCYRCLLETKELGCLLGSDICLTPAGSSCITLHKKNSSGSDVMVSDCRSKEQMSDCSNTRTSPVSGFWIFSQYCFLDFCNDPQNRGLYTP

SEQ ID NO: 2486 - protein, 201 aa, Homo sapiens
MKVHMLVGVLVMVGFTVGKVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 2487 - protein, 114 aa, Homo sapiens
MLGGEEARPNSWPWQVSLQYSSNGQWYHTCGGSLIANSWVLTAAHCIRQIIKAHKVLQRCSLILFFVRDLCSSQLELTGVSAGSSGIYRVMLGQHNLYVAESGSLAVSVSKIVV

SEQ ID NO: 2488 - protein, 269 aa, Homo sapiens
MIRTLLLSTLVAGALSCGVSTYAPDMSRMLGGEEARPNSWPWQVSLQYSSNGQWYHTCGGSLIANSWVLTAAHCISSSGIYRVMLGQHNLYVAESGSLAVSVSKIVVHKDWNSDQVSKGNDIALLKLANPVSLTDKIQLACLPPAGTILPNNYPCYVTGWGRLQTNGALPDDLKQGQLLVVDYATCSSSGWWGSTVKTNMICAGGDGVICTCNGDSGGPLNCQASDGRWEVHGIGSLTSVLGCNYYYKPSIFTRVSNYNDWINSVIANN

SEQ ID NO: 2489 - protein, 188 aa, Homo sapiens
MFHQIWAALLYFYGIILNSIYQCPEHSQLTTLGVDGKEFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 2490 - protein, 129 aa, Homo sapiens
MAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQGKGLKSHKTGLGLTKSSGVTG

SEQ ID NO: 2491 - protein, 116 aa, Homo sapiens
MAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 2492 - protein, 144 aa, Homo sapiens
MIRTLLLSTLVAGALSCGDPTYPPYVTRVVGGEEARPNSWPWQVSLQYSSNGKWYHTCGGSLIANSWVLTAAHCISQSMVQCAHKVLQRCSLILFFVRDLCSSQLELTGVSAGSSRTYRVGLGRHNLYVAESGSLAVSVSKIVV

SEQ ID NO: 2493 - protein, 67 aa, Homo sapiens
MKLLLLTLTVLLLLSQLTPGGTQRCWNLYGKCRYRCSKKERVYVYCINNKMCCVKPKYQPKERWWPF

SEQ ID NO: 2494 - protein, 76 aa, Homo sapiens
MKLLLLLLTVTLLLAQVTPVMKCWGKSGRCRTTCKESEVYYILCKTEAKCCVDPKYVPVKPKLTDTNTSLESTSAV

SEQ ID NO: 2495 - protein, 88 aa, Homo sapiens
MKLLYLFLAILLAIEEPVISVECWMDGHCRLLCKDGEDSIIRCRNRKRCCVPSRYLTIQPVTIHGILGWTTPQMSTTAPKMKTNITNR

SEQ ID NO: 2496 - protein, 84 aa, Homo sapiens
MKLLYLFLAILLAIEEPVISGKRHILRCMGNSGICRASCKKNEQPYLYCRNCQSCCLQSYMRISISGKEENTDWSYEKQWPRLP

SEQ ID NO: 2497 - protein, 876 aa, Homo sapiens; identical to SEQ ID NO: 1912

SEQ ID NO: 2498 - protein, 913 aa, Homo sapiens; identical to SEQ ID NO: 2128

SEQ ID NO: 2499 - protein, 876 aa, Homo sapiens; identical to SEQ ID NO: 1912

SEQ ID NO: 2500 - protein, 876 aa, Homo sapiens; identical to SEQ ID NO: 1912

SEQ ID NO: 2501 - protein, 919 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNASFSLFSRNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 2502 - protein, 346 aa, Homo sapiens
MLKKPLSAVTWLCIFIVAFVSHPAWLQKLSKHKTPAQPQLKAANCCEEVKELKAQVANLSSLLSELNKKQERDWVSVVMQVMELESNSKRMESRLTDAESKYSEMNNQIDIMQLQAAQTVTQTSADAIYDCSSLYQKNYRISGVYKLPPDDFLGSPELEVFCDMETSGGGWTIIQRRKSGLVSFYRDWKQYKQGFGSIRGDFWLGNEHIHRLSRQPTRLRVEMEDWEGNLRYAEYSHFVLGNELNSYRLFLGNYTGNVGNDALQYHNNTAFSTKDKDNDNCLDKCAQLRKGGYWYNCCTDSNLNGVYYRLGEHNKHLDGITWYGWHGSTYSLKRVEMKIRPEDFKP

SEQ ID NO: 2503 - protein, 351 aa, Homo sapiens
MKGRAVSFDPLACQGLNASPGSLTSPLRRIRSLTGREVLTPFPGLGTAAAPAQGGAHLKPHSLVLPITALPPPPLALRGRQATSKLPPFLSSPFPPSLCPWVPDPGFKETAFLYAVSSAALTHTLARACSAGRMERCTCDDSPGLESRQAWQWGVCGDNLKYSTKFLSNFLGSKRGNKDLRARADAHNTHVGIKAVKSGLRTTCKCHGVSGSCAVRTCWKQLSPFRETGQVLKLRYDSAVKVSSATNEALGRLELWAPARQGSLTKGLAPRSGDLVYMEDSPSFCRPSKYSPGTAGRVCSREASCSSLCCGRGYDTQSRLVAFSCHCQVQWCCYVECQQCVQEELVYTCKH

SEQ ID NO: 2504 - protein, 153 aa, Homo sapiens
MKHLRPQFPLILAIYCFCMLQIPSSGFPQPLADPSDGLDIVQLEQLAYCLSQWAPLSRQPKDNQDIYKRFLFHYSRTQEATHPVKTGFPPVHPLMHLAAKLANRRMKRILQRGSGTAAVDFTKKDHTATWGRPFFLFRPRNGRNIEDEAQIQW

SEQ ID NO: 2505 - protein, 254 aa, Homo sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWHIILGGAVLLTALRPAAPGPAPPPQEA

SEQ ID NO: 2506 - protein, 269 aa, Homo sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVLFLMMSGAPDTGGQGGGGGGGGGGGSGRCCVPPSL

SEQ ID NO: 2507 - protein, 159 aa, Homo sapiens
MSSPQRRKAMPWALSLLLMGFQLLVTYAWCSEEEMGGNNKIVQDPMFLATVEFALNTFNVQSKEEHAYRLLRVLSSWREDSMDRKWRGKMVFSMNLQLRQTVCRKFEDDIDNCPFQESLELNNVRQGISFPQVHSCGCCMGCGVGTGAADKAIPRDKGK

SEQ ID NO: 2508 - protein, 578 aa, Homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIVISRTHSPT

SEQ ID NO: 2509 - protein, 147 aa, Homo sapiens
MLGLPWKGGLSWALLLLLLGSQILLIYAWHFHEQRDCDEHNVMARYLPATVEFAVHTFNQQSKDYYAYRLGHILNSWKEQVESKTVFSMELLLGRTRCGKFEDDIDNCHFQESTELNNTFTCFFTISTRPWMTQFSLLNKTCLEGFH

SEQ ID NO: 2510 - protein, 147 aa, Homo sapiens
MWSLPPSRALSCAPLLLLFSFQFLVTYAWRFQEEEEWNDQKQIAVYLPPTLEFAVYTFNKQSKDWYAYKLVPVLASWKEQGYDKMTFSMNLQLGRTMCGKFEDDIDNCPFQESPELNNTCTCFFTIGIEPWRTRFDLWNKTCSGGHS

SEQ ID NO: 2511 - protein, 844 aa, Homo sapiens; identical to SEQ ID NO: 2289

SEQ ID NO: 2512 - protein, 899 aa, Homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 2513 - protein, 961 aa, Homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 2514 - protein, 293 aa, Homo sapiens
MNNLSFSELCCLFCCPPCPGKIASKLAFLPPDPTYTLMCDESGSRWTLHLSERADWQYSSREKDAIECFMTRTSKGNRIACMFVRCSPNAKYTLLFSHGNAVDLGQMSSFYIGLGSRINCNIFSYDYSGYGASSGKPTEKNLYADIEAAWLALRTRYGIRPENVIIYGQSIGTVPSVDLAARYESAAVILHSPLTSGMRVAFPDTKKTYCFDAFPNIDKISKITSPVLIIHGTEDEVIDFSHGLALFERCQRPVEPLWVEGAGHNDVELYGQYLERLKQFVSQELVQKHKEGK

SEQ ID NO: 2515 - protein, 384 aa, Homo sapiens
MWYVSTRGVAPRVNFEGALFSGYAPDGGLFMPEELPQLDRGTLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKHSPVLPRPCLCSQVPGSCPGCWPDP

SEQ ID NO: 2516 - protein, 962 aa, Homo sapiens
MLRRPAPALAPAARLLLAGLLCGGGVWAARVNKHKPWLEPTYHGIVTENDNTVLLDPPLIALDKDAPLRFAESFEVTVTKEGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMETYEDQHSSEEEEEEEEEEESEDGEEEDDITSAESESSEEEEGEQGDPQNATRQQQLEWDDSTLSY

SEQ ID NO: 2517 - protein, 981 aa, Homo sapiens
MLRRPAPALAPAARLLLAGLLCGGGVWAARVNKHKPWLEPTYHGIVTENDNTVLLDPPLIALDKDAPLRFAESFEVTVTKEGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMETYEDQHSSEEEEEEEEEEESEDGEEEDDITSAESESSEEEEGEQGDPQNATRQQQLEWDDSTLSY

SEQ ID NO: 2518 - protein, 225 aa, Homo sapiens
MSGCSKRCKLGFVKFAQTIFKLITGTLSKDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 2519 - protein, 139 aa, Homo sapiens
MYKLASCCLLFIGFLNPLLSLPLLDSREISFQLSAPHEDARLTPEELERASLLQILPEMLGAERGDILRKADSSTNIFNPRGNLRKFQDFSGQDPNILLSHLLARIWKPYKKQRRKLRQDLRLWKKEPGLRIFKNYVWV

SEQ ID NO: 2520 - protein, 292 aa, Homo sapiens
MEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMELAHGLQDQNLKISLTVCHQTTQ

SEQ ID NO: 2521 - protein, 260 aa, Homo sapiens
MKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQTDWSSPVSARSTEGEEPAVGPGLPRLRGPFWKFPGPGHAGLGAHPLHHPVIQQEGFLPAPRGFGYRSEVD

SEQ ID NO: 2522 - protein, 1207 aa, Homo sapiens
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTDAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSTKKQVILSSGTEFNAVKSLILGKVLEAAGADPDTRRAATSGFTGCLSAVRFGRAAPLKAALRPSGPSRVTVRGHVAPMARCAAGAASGSPARELAPRLAGGAGRSGPADEGEPLVNADRRDSAVIGGVIAVVIFILLCITAIAIRIYQQRKLRKENESKVSKKEEC

SEQ ID NO: 2523 - protein, 745 aa, Homo sapiens
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTDAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEW

SEQ ID NO: 2524 - protein, 182 aa, Homo sapiens
MEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQDCHQGQRELKFLCMLR

SEQ ID NO: 2525 - protein, 93 aa, Homo sapiens
MDSLRKMLISVAMLGAGAGVGYALLVIVTPGERRKQEMLKEMPLQDPRSREEAARTQQLLLATLQEAATTQENVAWRKNWMVGGEGGAGGRSP

SEQ ID NO: 2526 - protein, 128 aa, Homo sapiens
MGKSASKQFHNEVLKAHNEYRQKHGVPPLKLCKNLNREAQQYSEALASTRILKHSPESSRGQCGENLAWASYDQTGHFTAMVWKNTKKMGVGKASASDGSSFVVARYFPAGNVVNEGFFEENVLPPKK

SEQ ID NO: 2527 - protein, 154 aa, Homo sapiens
MGKSASKQFHNEVLKAHNEYRQKHGVPPLKLCKNLNREAQQYSEALASTRILKHSPESSRGQCGENLAWASYDQTGKEVADRWYSEIKNYNFQQPGFTSGTGHFTAMVWKNTKKMGVGKASASDGSSFVVARYFPAGNVVNEGFFEENVLPPKK

SEQ ID NO: 2528 - protein, 276 aa, Homo sapiens
MDSSREPTLGRLDAAGFWQVWQRFDADEKGYIEEKELDAFFLHMLMKLGTDDTVMKANLHKVKQQFMTTQDASKDGRIRMKELAGMFLSEDENFLLLFRRENPLDSSVEFMQIWRKYDADSSGFISAAELRNFLRDLFLHHKKAISEAKLEEYTGTMMKIFDRNKDGRLDLNDLARILALQENFLLQFKMDACSTEERKRDFEKIFAYYDVSKTGALEGPEVDGFVKDMMELVQPSISGVDLDKFREILLRHCDVNKDGKIQKSELALCLGLKINP

SEQ ID NO: 2529 - protein, 71 aa, Homo sapiens
MPAGVPMSTYLKMFAASLLAMCAGAEVVHRYYRPDLTIPEIPPKRGELKTELLGLKERKHKPQVSQQEELK

SEQ ID NO: 2530 - protein, 428 aa, Homo sapiens
MKPMLKDFSNLLLVVLCDYVLGEAEYLLLREPGHVALSNDTVYVDFQYFDGANGTLRNVSVLLLEANTNQTVTTKYLLTNQSQGTLKFECFYFKEAGDYWFTMTPEATDNSTPFPWWEKSAFLKVEWPVFHVDLNRSAKAAEGTFQVGLFTSQPLCPFPVDKPNIVVDVIFTNSLPEARRNSRQPLEIRTSKRTELAQGQWVEFGCAPLGPEAYVTVVLKLLGRDSVITSTGPIDLAQKFGYKLVMVPELTCESGVEVTVLPPPCTFVQGVVTVFKEAPRYPGKRTIHLAENSLPLGERRTIFNCTLFDMGKNKYCFDFGISSRSHFSAKEECMLIQRNTETWGLWQPWSQCSATCGDGVRERRRVCLTSFPSSPVCPGMSLEASLCSLEECAGRFRSCCPGWSAMVRSRLTNSASRVQAILLPQPLA

SEQ ID NO: 2531 - protein, 103 aa, Homo sapiens
MKLCVTVLSLLVLVAAFCSLALSAPMGSDPPTACCFSYTARKLPRNFVVDYYETSSLCSQPAVVYRESASSAAPGRIPSTRAAPHGPWSGRGRCLPQARDKAR

SEQ ID NO: 2532 - protein, 92 aa, Homo sapiens
MKLCVTVLSLLVLVAAFCSLALSAPMGSDPPTACCFSYTARKLPRNFVVDYYETSSLCSQPAVPWDSNLGKQVCADPSESWVQEYVYDLELN

SEQ ID NO: 2533 - protein, 93 aa, Homo sapiens
MQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 2534 - protein, 622 aa, Homo sapiens
MGKSEGPVGMVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKVELETQLAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKYRVLGSLQNLAAFADTFHCARGTPMHPKERCRVW

SEQ ID NO: 2535 - protein, 779 aa, Homo sapiens
MGKSEGPVGMVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKDRPAVEKARTLYRSCMNQSVIEKRGSQPLLDILEVVGGWPVAMDRWNETVGLEWELERQLALMNSQFNRRVLIDLFIWNDDQNSSRHIIYIDQPTLGMPSREYYFNGGSNRKVREAYLQFMVSVATLLREDANLPRDSCLVQEDMVQVLELETQLAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKYRVLGSLQNLAAFADTFHCARGTPMHPKERCRVW

SEQ ID NO: 2536 - protein, 85 aa, Homo sapiens
MSVHMPAMKICEKLKKLDSQICELKYEKTLDLASVDLRKMRVAELKQILHSWGEECRACAEKTDYVNLIQELAPKYAATHPKTEL

SEQ ID NO: 2537 - protein, 218 aa, Homo sapiens
MGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQTVTEGHIPFPQHLNIITPPPPPDEVFDSSGLSPGFLGYVVGRSDSVSTRLSNCDPPPTYEEATGQVNLQRSETEPHLDPPPEYEDIVNSNSASAIPMVPVVTTIK

SEQ ID NO: 2538 - protein, 454 aa, Homo sapiens; identical to SEQ ID NO: 2020

SEQ ID NO: 2539 - protein, 138 aa, Homo sapiens
MTWRQAVLLSCFSAVVLLSMLREGTSVSVGTMQMAGEEASEDAKQKIFMQESDASNFLKRRGKRSPKSRDEVNVENRQKLRVDELRREYYEEQRNEFENFVEEQNDEQEERSREAVEQWRQWHYDGLHPSYLYNRHHT

SEQ ID NO: 2540 - protein, 242 aa, Homo sapiens
MALKNKFSCLWILGLCLVATTSSKIPSITDPHFIDNCIEAHNEWRGKVNPPAADMKYMIWDKGLAKMAKAWANQCKFEHNDCLDKSYKCYAAFEYVGENIWLGGIKSFTPRHAITAWYNETQFYDFDSLSCSRVCGHYTQLVWANSFYVGCAVAMCPNLGGASTAIFVCNYGPAGNFANMPPYVRGESCSLCSKEEKCVKNLCRTPQLIIPNQNPFLKPTGRAPQQTAFNPFSLGFLLLRIF

SEQ ID NO: 2541 - protein, 270 aa, Homo sapiens
MLRQLLLAALCLAGPPAPARACQLPSEWRPLSEGCRAELAETIVYARVLALHPEAPGLYNHLPWQYHAGQGGLFYSAEVEMLCDQAWGSMLEVPAGSRLNLTGLGYFSCHSHTVVQDYSYFFFLRMDENYNLLPHGVNFQDAIFPDTQENRRMFSSLFQFSNCSQGQQLATFSSDWEIQEDSRLMCSSVQKALFEEEDHVKKLQQKVATLEKRNRQLRERVKKVKRSLRQARKKGRHLELANQKLSEKLAAGALPHINARGPVRPPYLRG

SEQ ID NO: 2542 - protein, 145 aa, Homo sapiens
MDENYNLLPHGVNFQDAIFPDTQENRRMFSSLFQFSNCSQGQQLATFSSDWEIQEDSRLMCSSVQKALFEEEDHVKKLQQKVATLEKRNRQLRERVKKVKRSLRQARKKGRHLELANQKLSEKLAAGALPHINARGPVRPPYLRG

SEQ ID NO: 2543 - protein, 609 aa, Homo sapiens
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMPCSSSPCFHDGTCVLDKAGSYKCACLAGYTGQRCENLLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 2544 - protein, 720 aa, Homo sapiens
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 2545 - protein, 377 aa, Homo sapiens
MEALLLGAGLLLGAYVLVYYNLVKAPPCGGMGNLRGRTAVVTGANSGIGKMTALELARRGARVVLACRSQERGEAAAFDLRQESGNNEVIFMALDLASLASVRAFATAFLSSEPRLDILIHNAGISSCGRTREAFNLLLRVNHIGPFLLTHLLLPCLKACAPSRVVVVASAAHCRGRLDFKRLDRPVVGWRQELRAYADTKLANVLFARELANQLEATGVTCYAAHPGPVNSELFLRHVPGWLRPLLRPLAWLVLRAPRGGAQTPLYCALQEGIEPLSGRYFANCHVEEVPPAARDDRAAHRLWEASKRLAGLGPGEDAEPDEDPQSEDSEAPSSLSTPHPEEPTVSQPYPSPQSSPDLSKMTHRIQAKVEPEIQLS

SEQ ID NO: 2546 - protein, 126 aa, Homo sapiens
MISFHVIFLSLGRGKLFLPVNFCFLKLKNSQVRIPKDFTCNLHVLFRTVQGEDRNTMFRGHWSIYSRNFPLAVVPAYVTEDGKNTSHRASGQFCNALSQGEIPSSLQLVNSYALEPRTDMPCNFLT

SEQ ID NO: 2547 - protein, 291 aa, Homo sapiens
MAVTLSLLLGGRVCAAVTRCGFATRGVAGPGPIGREPDPDSDWEPEERELQEVESTLKRQKQAIRFQKIRRQMEAPGAPPRTLTWEAMEQIRYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIESDTHRTNTPRRRKGRNKEIQDLEESFVPVAAPLGHPRELQKYSSDSESPRGTGSGALPSGQKLEELKAEEPDNFSSKVVQRGREFFDSNGNFLYRI

SEQ ID NO: 2548 - protein, 846 aa, Homo sapiens
MFKCWSVVLVLGFIFLESEGRPTKEGGYGLKSYQPLMRLRHKEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTLANILWREEGLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 2549 - protein, 96 aa, Homo sapiens
MRVTSATCALLLALICSVQLGDACLDIDKLLANVVFDVSQDLLKEELARYNPSPLTEESFLNVQQCFANVSVTERFAHSVVIKKILQSNDCIEAAF

SEQ ID NO: 2550 - protein, 656 aa, Homo sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 2551 - protein, 693 aa, Homo sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLGEMDSWKPGSVLLDEGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 2552 - protein, 184 aa, Homo sapiens
MFCLLHLCFYLANFASSIKRTHAVNGCCGLQMIALWAQSSGNADARVEEILAGEERRLAALLGSQGMRFWVCLAACRAMWGLAARRGRAEDSSSSPVDASKFPWRGGQHRTTMMPCLLRVGVFRPCHVRPTGDPSCDVQPPRLGFSRVPDTQVAFYGSGHWDPTPFSVHSCFFNFQVRKIIFLL

SEQ ID NO: 2553 - protein, 287 aa, Homo sapiens
MTSAAHYYPKLMSIMGNVLRFLPAFVRMKQLIEEGYVGEPLVCEVQVHGGSLLGKKYNWSCDDLMGGGGLHSVGTYIIDLLTFLTGQKAVKVHGLLKTFVKQTDHIKGIRQITSDDFCTFQMVLEGGVCCTVTLNFNVPGEFKQDVTVVGSAGRLLAVGTDLYGQRNSAPEQELLVQDATPVSNSLLPEKAFSDIPSPYLRGTIKMMQAVRQAFQDQDDRRTWDGRPLTMAATFDDCLYALCVVDTIKRSSQTGEWQNIAIMTEEPELSPAYLISEAMRRSRMSLYC

SEQ ID NO: 2554 - protein, 390 aa, Homo sapiens
MLPGVGVFGTSLTARVIIPLLKDEGFAVKALWGRTQEEAEELAKEMSVPFYTSRIDEVLLHQDVDLVCINLPPPLTRQIAVKTLGIGKNVICDRTATPLDAFRMTSAAHYYPKLMSIMGNVLRFLPAFVRMKQLIEEGYVGEPLVCEVQVHGGSLLGKKYNWSCDDLMGGGGLHSVGTYIIDLLTFLTGQKAVKVHGLLKTFVKQTDHIKGIRQITSDDFCTFQMVLEGGVCCTVTLNFNVPGEFKQDVTVVGSAGRLLAVGTDLYGQRNSAPEQELLVQDATPVSNSLLPEKAFSDIPSPYLRGTIKMMQAVRQAFQDQDDRRTWDGRPLTMAATFDDCLYALCVVDTIKRSSQTGEWQNIAIMTEEPELSPAYLISEAMRRSRMSLYC

SEQ ID NO: 2555 - protein, 1905 aa, Homo sapiens
MQSRLLLLGAPGGHGGPASRRMRLLLRQVVQRRPGGDRQRPEVRLLHAGSGADTGDTVNIGDVSYKLKIPKNPELVPQNYISDSLAQSVVQHLRWIMQKDLLGQDVFLIGPPGPLRRSIAMQYLELTKREVEYIALSRDTTETDLKQRREIRAGTAFYIDQCAVRAATEGRTLILEGLEKAERNVLPVLNNLLENREMQLEDGRFLMSAERYDKLLRDHTKKELDSWKIVRVSENFRVIALGLPVPRYSGNPLDPPLRSRFQARDIYYLPFKDQLKLLYSIGANVSAEKVSQLLSFATTLCSQESSTLGLPDFPLDSLAAAVQILDSFPMMPIKHAIQWLYPYSILLGHEGKMAVEGVLKRFELQDSGSSLLPKEIVKVEKMMENHVSQASVTIRIADKEVTIKVPAGTRLLSQPCASDRFIQTLSHKQLQAEMMQSHMVKDICLIGGKGCGKTVIAKNFADTLGYNIEPIMLYQDMTARDLLQQRYTLPNGDTAWRSSPLVNAALEGKLVLLDGIHRVNAGTLAVLQRLIHDRELSLYDGSRLLREDRYMRLKEELQLSDEQLQKRSIFPIHPSFRIIALAEPPVIGSTAHQWLGPEFLTMFFFHYMKPLVKSEEIQVIKEKVPNVPQEALDKLLSFTHKLRETQDPTAQSLAASLSTRQLLRISRRLSQYPNENLHSAVTKACLSRFLPSLARSALEKNLADATIEINTDDNLEPELKDYKCEVTSGTLRIGAVSAPIYNAHEKMKVPDVLFYDNIQHVIVMEDMLKDFLLGEHLLLVGNQGVGKNKIVDRFLHLLNRPREYIQLHRDTTVQTLTLQPSVKDGLIVYEDSPLVKAVKLGHILVVDEADKAPTNVTCILKTLVENGEMILADGRRIVANSANVNGRENVVVIHPDFRMIVLANRPGFPFLGNDFFGTLGDIFSCHAVDNPKPHSELEMLRQYGPNVPEPILQKLVAAFGELRSLADQGIINYPYSTREVVNIVKHLQKFPTEGLSSVVRNVFDFDSYNNDMREILINTLHKYGIPIGAKPTSVQLAKELTLPEQTFMGYWTIGQARSGMQKLLCPVETHHIDIKGPALINIQEYPIERHEERSLNFTEECASWRIPLDEINIICDIATSHENEQNTLYVVTCNPASLYFMNMTGKSGFFVDFFDIFPRTANGVWHPFVTVAPLGSPLKGQVVLHEQQSNVILLLDTTGRALHRLILPSEKFTSKKPFWWNKEEAETYKMCKEFSHKNWLVFYKEKGNSLTVLDVLEGRTHTISLPINLKTVFLVAEDKWLLVESKTNQKYLLTKPAHIESEGSGVCQLYVLKEEPPSTGFGVTQETEFSIPHKISSDQLSSEHLSSAVEQKIASPNRILSDEKNYATIVVGFPDLMSPSEVYSWKRPSSLHKRSGTDTSFYRGKKKRGTPKQSNCVTLLDTNQVVRILPPGEVPLKDIYPKDVTPPQTSGYIEVTDLQSKKLRYIPIPRSESLSPYTTWLSTISDTDALLAEWDKSGVVTVDMGGHIRLWETGLERLQRSLMEWRNMIGQDDRNMQITINRDSGEDVSSPKHGKEDPDNMPHVGGNTWAGGTGGRDTAGLGGKGGPYRLDAGHTVYQVSQAEKDAVPEEVKRAAREMGQRAFQQRLKEIQMSEYDAATYERFSGAVRRQVHSLRIILDNLQAKGKERQWLRHQATGELDDAKIIDGLTGEKAIYKRRGELEPQLGSPQQKPKRLRLVVDVSGSMYRFNRMDGRLERTMEAVCMVMEAFENYEEKFQYDIVGHSGDGYNIGLVPMNKIPKDNKQRLEILKTMHAHSQFCMSGDHTLEGTEHAIKEIVKEEADEYFVIVLSDANLSRYGIHPAKFAQILTRDPQVNAFAIFIGSLGDQATRLQRTLPAGRSFVAMDTKDIPQILQQIFTSTMLSSV

SEQ ID NO: 2556 - protein, 186 aa, Homo sapiens
MEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWSVSYTYIRRKKRMDLLLKHGQITLDMI

SEQ ID NO: 2557 - protein, 271 aa, Homo sapiens
MEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 2558 - protein, 185 aa, Homo sapiens
MDHRSRLRGTGLNRIPGTQSRAPRVPLPFHVQQEAREGEDWEREPPRQRPPIYEPPESEELPDNVMVSKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTL

SEQ ID NO: 2559 - protein, 280 aa, Homo sapiens
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSDFMILWLHGENGTGPAKFNIPHSVTLDSAGRVWVADRGNKRIQVFDKDTGEWLGAWNNCFTEEGPSSVRFTPDGKYLIVAQLNLSRLSVVAAPPVGSIGECSVISTIQLADQVLPHLLEVDRKTGAVYVAEIGAKQVQKYVPLNSYVPSFGS

SEQ ID NO: 2560 - protein, 347 aa, Homo sapiens
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSGFFGHTVKKYSSFGDLVQVLGTPGKKGTSLNPLQFDNPAELYVEDTGDIYIVDGDGGLNNRLIKLSQDFMILWLHGENGTGPAKFNIPHSVTLDSAGRVWVADRGNKRIQVFDKDTGEWLGAWNNCFTEEGPSSVRFTPDGKYLIVAQLNLSRLSVVAAPPVGSIGECSVISTIQLADQVLPHLLEVDRKTGAVYVAEIGAKQVQKYVPLNSYVPSFGS

SEQ ID NO: 2561 - protein, 568 aa, Homo sapiens
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYFISSSSPSGLYQLDLLSTEKDTHFKVYATTTPESDQPYPELPYDPRVDVTSLGRTTVTLAWKPSPTASLLKQPIQYCVVINKEHNFKSLCAVEAKLSADDAFMMAPKPGLDFSPFDFAHFGFPSDNSGKERSFQAKPSPKLGRHVYSRPKVDIQKICIGNKNIFTVSDLKPDTQYYFDVFVVNINSNMSTAYVGTFARTKEEAKQKTVELKDGKITDVFVKRKGAKFLRFAPVSSHQKVTFFIHSCLDAVQIQVRRDGKLLLSQNVEGIQQFQLRGKPKAKYLVRLKGNKKGASMLKILATTRPTKQSFPSLPEDTRIKAFDKLRTCSSATVAWLGTQERNKFCIYKKEVDDNYNEDQKKREQNQCLGPDIRKKSEKVLCKYFHSQNLQKAVTTETIKGLQPGKSYLLDVYVIGHGGHSVKYQSKVVKTRKFC

SEQ ID NO: 2562 - protein, 162 aa, Homo sapiens; identical to SEQ ID NO: 1861

SEQ ID NO: 2563 - protein, 565 aa, Homo sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 2564 - protein, 470 aa, Homo sapiens
MKRSVAVWLLVGLSLGVPQFGKGDICDPNPCENGGICLPGLADGSFSCECPDGFTDPNCSSVVEVGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 2565 - protein, 417 aa, Homo sapiens
MASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 2566 - protein, 161 aa, Homo sapiens
MLMPVHFLLLLLLLLGGPRTGLPHKFYKAKPIFSCLNTALSEAEKGQWEDASLLSKRSFHYLRSRDASSGEEEEGKEKKTFPISGARGGARGTRYRYVSQAQPRGKPRQDTAKSPHRTKFTLSLDVPTNIMNLLFNIAKAKNLRAQAAANAHLMAQIGRKK

SEQ ID NO: 2567 - protein, 696 aa, Homo sapiens
MAMARLGSWLGEAQWLALVSLFVAALATVGLYLAQWALARARPQPQRRAVEPGEGPRPGSDALLSWILTLGSWRSQWQAAWVTALNEEAERKGGPPFLSFEEDPRQQALELVVQEVSSVLRSAEEKVVVCHVVGQAIQFLVSETPALGAGCRLYDMRLSPFHLQLEFHMKEKREDLQISWSFISVPEMAVNIQPKALGEDQVAETSAMSDVLKDILKHLAGSASPSVVLITKPTTVKEAQNLQCAASTAQESCPPKPPRAHELKLLVRNIHVLLLSEPGASGHINAVCVVQLNDPVQRFSSTLTKNTPDLMWEEEFTFELNAKSKELHLQISEAGRSSEGLLATATVPLDLFKKQPSGPQSFTLTSGSACGSSVLGSVTAEFSYMEPGELKSWPIPPPVPAAKIEKDRTVMPCGTVVTTVTAVKTKPRVDVGRASPLSSDSPVKTPIKVKVIEKDISVQAIACRSAPVSKTLSSSDTELLVLNGSDPVAEVAIRQLSESSKLKLKSPRKKSTIIISGISKTSLSQDHDAALMQGYTASVDSTHQEDAPSHPERAAASAPPEEAESAQASLAPKPQEDELDSWDLEKEPQAAAWSSQVLLDPDGDELSESSMSVLEPGTAKKHKGGILRKGAKLFFRRRHQQKDPGMSQSHNDLVFLEQPEGSRRKGITLTRILNKKLLSRHRNKNTMNGAPVEPCT

SEQ ID NO: 2568 - protein, 222 aa, Homo sapiens
MPASSPFLLAPKGPPGNMGGPVREPALSVALWLSWGAALGAVACAMALLTQQTELQSLRREVSRLQGTGGPSQNGEGYPWQSLPEQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 2569 - protein, 734 aa, Homo sapiens
MWGLLLALAAFAPAVGPALGAPRNSVLGLAQPGTTKVPGSTPALHSSPAQPPAETANGTSEQHVRIRVIKKKKVIMKKRKKLTLTRPTPLVTAGPLVTPTPAGTLDPAEKQETGCPPLGLESLRVSDSRLEASSSQSFGLGPHRGRLNIQSGLEDGDLYDGAWCAEEQDADPWFQVDAGHPTRFSGVITQGRNSVWRYDWVTSYKVQFSNDSRTWWGSRNHSSGMDAVFPANSDPETPVLNLLPEPQVARFIRLLPQTWLQGGAPCLRAEILACPVSDPNDLFLEAPASGSSDPLDFQHHNYKAMRKLMKQVQEQCPNITRIYSIGKSYQGLKLYVMEMSDKPGEHELGEPEVRYVAGMHGNEALGRELLLLLMQFLCHEFLRGNPRVTRLLSEMRIHLLPSMNPDGYEIAYHRGSELVGWAEGRWNNQSIDLNHNFADLNTPLWEAQDDGKVPHIVPNHHLPLPTYYTLPNATVAPETRAVIKWMKRIPFVLSANLHGGELVVSYPFDMTRTPWAARELTPTPDDAVFRWLSTVYAGSNLAMQDTSRRPCHSQDFSVHGNIINGADWHTVPGSMNDFSYLHTNCFEVTVELSCDKFPHENELPQEWENNKDALLTYLEQVRMGIAGVVRDKDTELGIADAVIAVDGINHDVTTAWGGDYWRLLTPGDYMVTASAEGYHSVTRNCRVTFEEGPFPCNFVLTKTPKQRLRELLAAGAKVPPDLRRRLERLRGQKD

SEQ ID NO: 2570 - protein, 252 aa, Homo sapiens
MRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQLRRQYVRKYEGEAEERKKLRQENGNVHAIA

SEQ ID NO: 2571 - protein, 2828 aa, Homo sapiens; identical to SEQ ID NO: 1842

SEQ ID NO: 2572 - protein, 1109 aa, Homo sapiens
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRGYNQILIVPMGATSILIDEAAASRNFLAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHAYPVRCLLPSAHGSCADWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPSTHRPAQGPWQGLRRPARAGQL

SEQ ID NO: 2573 - protein, 134 aa, Homo sapiens
MKSVLLLTTLLVPAHLVAAWSNNYAVDCPQHCDSSECKSSPRCKRTVLDDCGCCRVCAAGRGETCYRTVSGMDGMKCGPGLRCQPSNGEDPFGEEFGICKEHDMASGDGNIVREEVVKENAAGSPVMRKWLNPR

SEQ ID NO: 2574 - protein, 184 aa, Homo sapiens
MKSVLLLTTLLVPAHLVAAWSNNYAVDCPQHCDSSECKSSPRCKRTVLDDCGCCRVCAAGRGETCYRTVSGMDGMKCGPGLRCQPSNGEDPFGEEFGICKDCPYGTFGMDCRETCNCQSGICDRGTGKCLKFPFFQYSVTKSSNRFVSLTEHDMASGDGNIVREEVVKENAAGSPVMRKWLNPR

SEQ ID NO: 2575 - protein, 198 aa, Homo sapiens
MPIPASPLHPPLPSLLLYLLLELAGVTHVFHVQQTEMSQTVSTGESIILSCSVPNTLPNGPVLWFKGTGPNRKLIYNFKQGNFPRVKEIGDTTKPGNTDFSTRIREISLADAGTYYCVKFIKGRAIKEYQSGRGTQVFVTAEQNPRPPKNRPAGRAGSRAHHDAHTCLSALPERNSTNYFVQPCCCLRLLGLTGLLSK

SEQ ID NO: 2576 - protein, 197 aa, Homo sapiens
MPIPASPLHPPLPSLLLYLLLELAGVTHVFHVQQTEMSQTVSTGESIILSCSVPNTLPNGPVLWFKGTGPNRKLIYNFKQGNFPRVKEIGDTTKPGNTDFSTRIREISLADAGTYYCVKFIKGRAIKEYQSGRGTQVFVTEQNPRPPKNRPAGRAGSRAHHDAHTCLSALPERNSTNYFVQPCCCLRLLGLTGLLSK

SEQ ID NO: 2577 - protein, 520 aa, Homo sapiens
MTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDISEEAKTLTMDILTLAHTSTEAKGLSSESSASSDGPHPVITPSRASESSASSDGPHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTNTKPHITEVTASAETLSTAGTTESAAPDATIGTPLPTNSTIEREVTAPGATTLSGALATGNPLEETSALSVETPSYVKVSGAAPVSIEAGSAVGKTTSFAGSSASSYSPLEAALKNFTPSETLTTDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 2578 - protein, 199 aa, Homo sapiens
MLWRQLIYWQLLALFFLPFCLCQDEYMESPQTGGLPPDCSKCCHHGNNGNNGATGHKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 2579 - protein, 319 aa, Homo sapiens
MLWRQLIYWQLLALFFLPFCLCQDEYMEVSGRTNKVVARIVQSHQQTGRSGSRREKVRERSHPKTGTVDNNTSTDLKSLRPDELPHPEVDDLAQITTFWGQSPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 2580 - protein, 284 aa, Homo sapiens
MTKSSLRPLQKQSPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETKCHGETPAGPRDSAAGKSKAYLCQAEWIWPVRKLLPVSWPRYQLFGFVRWKEQHI

SEQ ID NO: 2581 - protein, 77 aa, Homo sapiens
MATRSVLLALVVLNLLFYVPPGRSGPNVYIQKIFASCWRLQGTCRPKCLKNEQYRILCDTIHLCCVNPKYLPILTGK

SEQ ID NO: 2582 - protein, 78 aa, Homo sapiens
MNLCLSALLFFLVILLPSGKGMFGNDGVKVRTCTSQKAVCFFGCPPGYRWIAFCHNILSCCKNMTRFQPPQAKDPWVH

SEQ ID NO: 2583 - protein, 208 aa, Homo sapiens
MGAQGAQESIKAMWRVPGTTRRPVTGESPGMHRPEAMLLLLTLALLGGPTWAGKMYGPGGGKYFSTTEDYDHEITGLRVSVGLLLVKSVQVKLGDSWDVKLGALGGNTQEVTLQPGEYITKVFVAFQAFLRGMVMYTSKDRYFYFGKLDGQISSAYPSQEGQVLVGIYGQYQLLGIKSIGFEWNYPLEEPTTEPPVNLTYSANSPVGR

SEQ ID NO: 2584 - protein, 95 aa, Homo sapiens
MKFLLLVLAALGFLTQVIPASAGGSKCVSNTPGYCRTCCHWGETALFMCNASRKCCISYSFLPKPDLPQLIGNHWQSRRRNTQRKDKKQQTTVTS

SEQ ID NO: 2585 - protein, 112 aa, Homo sapiens
MFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEK

SEQ ID NO: 2586 - protein, 99 aa, Homo sapiens
MGLFMIIAILLFQKPTVTEQLKKCWNNYVQGHCRKICRVNEVPEALCENGRYCCLNIKELEACKKITKPPRPKPATLALTLQDYVTIIENFPSLKTQST

SEQ ID NO: 2587 - protein, 111 aa, Homo sapiens
MKSLLFTLAVFMLLAQLVSGNWYVKKCLNDVGICKKKCKPEEMHVKNGWAMCGKQRDCCVPADRRANYPVFCVQTKTTRISTVTATTATTTLMMTTASMSSMAPTPVSPTG

SEQ ID NO: 2588 - protein, 565 aa, Homo sapiens
MEDSDSAAKQLGLAEAAAVAAAAAVAAAAAAAAGGEAEEPVLSRDEDSEEDADSEAERETPRVTAVAVMAAEPGHMDMGAEALPGPDEAAAAAAFAEVTTVTVANVGAAADNVFTTSVANAASISGHVLSGRTALQIGDSLNTEKATLIVVHTDGSIVETTGLKGPAAPLTPGPQSPPTPLAPGQEKGGTKYNWDPSVYDSELPVRCRNISGTLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEQSCVNCGREAMSECTGCHKVNYCSTFCQRKDWKDHQHICGQSAAVTVQADEVHVAESVMEKVTV

SEQ ID NO: 2589 - protein, 156 aa, Homo sapiens
MNILMLTFIICGLLTRVTKGSFEPQKCWKNNVGHCRRRCLDTERYILLCRNKLSCCISIISHEYTRRPAFPVIHLEDITLDYSDVDSFTGSPVSMLNDLITFDTTKFGETMTPETNTPETTMPPSEATTPETTMPPSETATSETMPPPSQTALTHN

SEQ ID NO: 2590 - protein, 278 aa, Homo sapiens
MGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 2591 - protein, 1012 aa, Homo sapiens
MAEAALEAVRSELREFPAAARELCVPLAVPYLDKPPTPLHFYRDWVCPNRPCIIRNALQHWPALQKWSLPYFRATVGSTEVSVAVTPDGYADAVRGDRFMMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 2592 - protein, 515 aa, Homo sapiens
MAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYILWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 2593 - protein, 94 aa, Homo sapiens
MRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 2594 - protein, 139 aa, Homo sapiens
MGNPGGVGSERMRVARRTRNVCRCPRAAGPGVPEPRAAPLPLLAMAPPPACRSPMSPPPPPLLLLLLSLALLGARARAEPAGSAVPAQSRPCVDCHAFEFMQRALQDLRKTACSLDARTETLLLQAERRALCACWPAGH

SEQ ID NO: 2595 - protein, 156 aa, Homo sapiens
MAPAVTRLLFLQLVLGPTLVMDIKMQIGSRNFYTLSIDYPRVNYPKGFRGYCNGLMSYMRGKMQNSDCPKIHYVIHAPWKAIQKFCKYSDSFCENYNEYCTLTQDSLPITVCSLSHQQPPTSCYYNSTLTNQKLYLLCSRKYEADPIGIAGLYSGI

SEQ ID NO: 2596 - protein, 147 aa, Homo sapiens
MIIMVIIFLVLLFWENEVNDEAVMSTLEHLHVDYPQNDVPVPARYCNHMIIQRVIREPDHTCKKEHVFIHERPRKINGICISPKKVACQNLSAIFCFQSETKFKMTVCQLIEGTRYPACRYHYSPTEGFVLVTCDDLRPDSFLGYVK

SEQ ID NO: 2597 - protein, 150 aa, Homo sapiens; identical to SEQ ID NO: 2126

SEQ ID NO: 2598 - protein, 913 aa, Homo sapiens; identical to SEQ ID NO: 2128

SEQ ID NO: 2599 - protein, 150 aa, Homo sapiens; identical to SEQ ID NO: 2126

SEQ ID NO: 2600 - protein, 188 aa, Homo sapiens; identical to SEQ ID NO: 2489

SEQ ID NO: 2601 - protein, 844 aa, Homo sapiens; identical to SEQ ID NO: 2289

SEQ ID NO: 2602 - protein, 78 aa, Homo sapiens; identical to SEQ ID NO: 2320

SEQ ID NO: 2603 - protein, 899 aa, Homo sapiens; identical to SEQ ID NO: 2512

SEQ ID NO: 2604 - protein, 961 aa, Homo sapiens; identical to SEQ ID NO: 2513

SEQ ID NO: 2605 - protein, 844 aa, Homo sapiens; identical to SEQ ID NO: 2289

SEQ ID NO: 2606 - protein, 844 aa, Homo sapiens; identical to SEQ ID NO: 2289

SEQ ID NO: 2607 - protein, 899 aa, Homo sapiens; identical to SEQ ID NO: 2512

SEQ ID NO: 2608 - protein, 961 aa, Homo sapiens; identical to SEQ ID NO: 2513

SEQ ID NO: 2609 - protein, 844 aa, Homo sapiens; identical to SEQ ID NO: 2289

SEQ ID NO: 2610 - protein, 1029 aa, Homo sapiens
MPPTKSVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLVPATILEPVLRTEASGTTAVPATIFEPVSPIKEAPGTTFVPVTDLEPVTFRTEIPATTLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKTSQRTRRPRPKTKTTPSPEVPQTKLVPSTDLEPGTLRTEAPKTMVVTTVLEPDTFRTKFPETTLAPKTQRTRRPRPRPKTTSSPEVPQNKSVSVTGFEPVVHSTDAPGTTFALTELQTLILKPVTSPSLEMTESQPVSDVLESVTLSTESPKETIAPAKTDYVYPTAKAPLWPEEPKTEVVESITYVSEPPETTLETSPLPSQSITLPSPDEPQTEPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 2611 - protein, 784 aa, Homo sapiens
MTIVPTTDIEPVTVRTEATVTTLAPKTSQRTRTRRPRPKHKTTPRPETLQTKLDFGPITPGTSSAPTTTTKRTRRPHPKPKTTPHPEVPQTKLAPKVPQRTHRPHPKPKTTLSPEELQTELVPVTDLEPVTFRTEIPATTLATKTSKRTRPPRPRPKTTPSPQAPETKPVPATVLEPVTLRPEASTTLASKTSQRTRRPRLRTKTTPRPEAPESKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 2612 - protein, 527 aa, Homo sapiens
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMHVLCQPKETSDSSLVCSRYLQYCRATNLYLDLRNIKRNHDRFKEDFFQSGEIGGHCKLDIRTLTSEGQRKSPLQSWFAELQSYTQLNFRPIEDAKCDIVIEKPTYFMKLDAGVNMYHHFCDFINLYITQHVNNSFSTDVYIVMWDTSSYGYGDLFSDTWNAFTDYDVIHLKTYDSKRVCFKEAVFSLLPRMRYGLFYNTPLISGCQNTGLFRAFAQHVLHRLNITQEGPKDGKIRVTILARSTEYRKILNQNELVNALKTVSTFEVQIVDYKYRELGFLDQLRITHNTDIFIGMHGAGLTHLLFLPDWAAVFELYNCEDERCYLDLARLRGVHYITWRRQNKVFPQDKGHHPTLGEHPKFTNYSFDVEEFMYLVLQAADHVLQHPKWPFKKKHDEL

SEQ ID NO: 2613 - protein, 667 aa, Homo sapiens; identical to SEQ ID NO: 2011

SEQ ID NO: 2614 - protein, 366 aa, Homo sapiens
MPMISVLGKMFLWQREGPGGRWTCQTSRRVSSDPAWAVEWIELPRGLSLSSLGSARTLRGWSRSSRPSSVDSQDLPEVNVGDTVAMLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 2615 - protein, 1723 aa, Homo sapiens
MQFQLTLFLHLGWLSYSKAQDDCNRGACHPTTGDLLVGRNTQLMASSTCGLSRAQKYCILSYLEGEQKCFICDSRFPYDPYDQPNSHTIENVIVSFEPDREKKWWQSENGLDHVSIRLDLEALFRFSHLILTFKTFRPAAMLVERSTDYGHNWKVFKYFAKDCATSFPNITSGQAQGVGDIVCDSKYSDIEPSTGGEVVLKVLDPSFEIENPYSPYIQDLVTLTNLRINFTKLHTLGDALLGRRQNDSLDKYYYALYEMIVRGSCFCNGHASECRPMQKMRGDVFSPPGMVHGQCVCQHNTDGPNCERCKDFFQDAPWRPAADLQDNACRSCSCNSHSSRCHFDMTTYLASGGLSGGVCEDCQHNTEGQHCDRCRPLFYRDPLKTISDPYACIPCECDPDGTISGGICVSHSDPALGSVAGQCLCKENVEGAKCDQCKPNHYGLSATDPLGCQPCDCNPLGSLPFLTCDVDTGQCLCLSYVTGAHCEECTVGYWGLGNHLHGCSPCDCDIGGAYSNVCSPKNGQCECRPHVTGRSCSEPAPGYFFAPLNFYLYEAEEATTLQGLAPLGSETFGQSPAVHVVLGEPVPGNPVTWTGPGFARVLPGAGLRFAVNNIPFPVDFTIAIHYETQSAADWTVQIVVNPPGGSEHCIPKTLQSKPQSFALPAATRIMLLPTPICLEPDVQYSIDVYFSQPLQGESHAHSHVLVDSLGLIPQINSLENFCSKQDLDEYQLHNCVEIASAMGPQVLPGACERLIISMSAKLHDGAVACKCHPQGSVGSSCSRLGGQCQCKPLVVGRCCDRCSTGSYDLGHHGCHPCHCHPQGSKDTVCDQVTGQCPCHGEVSGRRCDRCLAGYFGFPSCHPCPCNRFAELCDPETGSCFNCGGFTTGRNCERCIDGYYGNPSSGQPCRPCLCPDDPSSNQYFAHSCYQNLWSSDVICNCLQGYTGTQCGECSTGFYGNPRISGAPCQPCACNNNIDVTDPESCSRVTGECLRCLHNTQGANCQLCKPGHYGSALNQTCRRCSCHASGVSPMECPPGGGACLCDPVTGACPCLPNVTGLACDRCADGYWNLVPGRGCQSCDCDPRTSQSSHCDQLTGQCPCKLGYGGKRCSECQENYYGDPPGRCIPCDCNRAGTQKPICDPDTGMCRCREGVSGQRCDRCARGHSQEFPTCLQCHLCFDQWDHTISSLSKAVQGLMRLAANMEDKRETLPVCEADFKDLRGNVSEIERILKHPVFPSGKFLKVKDYHDSVRRQIMQLNEQLKAVYEFQDLKDTIERAKNEADLLLEDLQEEIDLQSSVLNASIADSSENIKKYYHISSSAEKKINETSSTINTSANTRNDLLTILDTLTSKGNLSLERLKQIKIPDIQILNEKVCGDPGNVPCVPLPCGGALCTGRKGHRKCRGPGCHGSLTLSTNALQKAQEAKSIIRNLDKQVRGLKNQIESISEQAEVSKNNALQLREKLGNIRNQSDSEEENINLFIKKVKNFLLEENVPPEDIEKVANGVLDIHLPIPSQNLTDELVKIQKHMQLCEDYRTDENRLNEEADGAQKLLVKAKAAEKAANILLNLDKTLNQLQQAQITQGRANSTITQLTANITKIKKNVLQAENQTREMKSELELAKQRSGLEDGLSLLQTKLQRHQDHAVNAKVQAESAQHQAGSLEKEFVELKKQYAILQRKTSTTGLTKETLGKVKQLKDAAEKLAGDTEAKIRRITGCFQNSAR

SEQ ID NO: 2616 - protein, 1761 aa, Homo sapiens; identical to SEQ ID NO: 1838

SEQ ID NO: 2617 - protein, 484 aa, Homo sapiens
MGAEALPGPDEAAAAAAFAEVTTVTVANVGAAADNVFTTSVANAASISGHVLSGRTALQIGDSLNTEKATLIVVHTDGSIVETTGLKGPAAPLTPGPQSPPTPLAPGQEKGGTKYNWDPSVYDSELPVRCRNISGTLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEQSCVNCGREAMSECTGCHKVNYCSTFCQRKRWSLTMLTSLVSISWLRAILPCQPPKVLGL

SEQ ID NO: 2618 - protein, 503 aa, Homo sapiens
MSGALLWPLLPLLLLLLSARDGVRAAQPQAPGYLIAAPSVFRAGVEEVISVTIFNSPREVTVQAQLVAQGEPVVQSQGAILDKGTIKLKVPTGLRGQALLKVWGRGWQAEEGPLFHNQTSVTVDGRGASVFIQTDKPVYRPQHRVLISIFTVSPNLRPVNEKLEAYILDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALMINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLEVFQELEDYDVSDSFGVSREDGPFWWAGLTAQRRRRSSVFPWPWGITKDSGFAFTVRRGNGTGGDDRPSEPEPPAGRWPLHR

SEQ ID NO: 2619 - protein, 47 aa, Homo sapiens
MKLCVTVLSLLVLVAAFCSLALSAPKASKSALTPVSPGSRSTCMTWN

SEQ ID NO: 2620 - protein, 286 aa, Homo sapiens
MEVYIRHLEKVLRRYVQRLQWLLSGPVLCSRTWYRQSMDRGVMMTAASGSRRLFGTVLESKVCILLDTSGSMGPYLQQVKTELVLLIWEQLRKCCDSFNLLSFAESFQSWQDTLVETTDAACHEAMQWVTHLQAQGSTSILQALLKAFSFHDLEGLYLLTDGKPDTSCSLVLNEVQKLREKRDVKVHTISLNCSDRAAVEFLRKLASFTGGRYHCPVGEDTLSKIHSLLTKGFINEKDPTLPPFEGDDLRILAQEITKARSFLWQAQSFRSQLQKKNDAEPKVTLS

SEQ ID NO: 2621 - protein, 1184 aa, Homo sapiens
MKKYRKISIGCFAMATQTSHVFHGQENMFLENHCIRRNTGRDSKKPLKQKNMNGLGQNSDNGLLVTHVNQTQDLLRLQGSETQSSDWEDSEDWLSAHSLKCQKLTLADLISQGTEVLEEGTNVVQKICFSTQIIRHFESKLSDTIEVYQERIQWLTENSKKAFGLIKGARVSILIDVSAISSGPQKEEFQKDLMSLIDEQLSHKEKLFVLSFGTNAGSLWPDPMEVSASTLQELKLWVKTLQPDGGSNLLQALKKIFTLKGLDSLVAIMRSCPDQPSEILSDYIQQSTMGRDLIIHFITYRCDDQMPPAVLKNLAEAVRGYYHCYSPKMEHYTSRDMDELLAEIQKAQSLLSHVQALQHSSPCEALTCTMEEISTEITNGPLISLLPKPPKHDAPLTIEFPNLDKTSAEWLKVNGLKAKKLSLYQVLAPNAFSPVEEFVPILQKTVSSTIHEKAMIQFEWHDGTVKNIHVDPPFLYKYQQQLSRAMRMYERRIEWLSLASRRIWGTVCEKRVVVLLDISATNSMYIIHIQHSLRLLLEEQLSNKDCFNLIAFGSTIESWRPEMVPVSHNNLQSAWRWALNLRCRGSRNVLSALRKAVEVDFKDKDKHQSQGIYLFTGGIPDQDMPTLSAYMAEACGGCDLQLNVCLFYVGEPKMDTTPPARYASHTDTAAAYKEVTRAAGGRFHWFGDTGIYESDDINSIMSEMEKALNYSQKCAFLMASLKNHSGKVLGSSALPKEKPKTLQLRSQPKKLCPPRPTVPLGARMSIKDDPDREKSPPLKSLKWRPLSSRVGISPAAAQPTKEGMMELRRKTKSREAETSLLLFYTEKGNDVGSVYKKYPQGRGLRRTSSSIDLPRKDTVCSSQEWVAKYGLKKLKLEISRCMGPNCTHQKSGQRSASAKHCSIFPSVEIHGVVRHIQWTPREMEVYIRHLEKVLRRYVQRLQWLLSGSRRLFGTVLESKVCILLDTSGSMGPYLQQVKTELVLLIWEQLRKCCDSFNLLSFAESFQSWQDTLVETTDAACHEAMQWVTHLQAQGSTSILQALLKAFSFHDLEGLYLLTDGKPDTSCSLVLNEVQKLREKRDVKVHTISLNCSDRAAVEFLRKLASFTGGRYHCPVGEDTLSKIHSLLTKGFINEKDPTLPPFEGDDLRILAQEITKARSFLWQAQSFRSQLQKKNDAEPKVTLS

SEQ ID NO: 2622 - protein, 301 aa, Homo sapiens; identical to SEQ ID NO: 1916

SEQ ID NO: 2623 - protein, 1573 aa, Homo sapiens
MRVLACLLAALVGIQAVERLRLADGPHGCAGRLEVWHGGRWGTVCDDGWDLRDAAVACRQLGCGGALAAPGGAFFGEGAGPVWLSELACRGNEGQLGLCHHRGWKAHICSHEEDAGVVCAGQRVANSRDDSTSPLDGAPWPGLLLELSPSTEEPLVTHAPRPAGNPQNASRKKSPRPKQAKSTRAPLLTTGAPRQERLRLVSGPHRCAGRLEVWHGGRWGTVCDDGWDLRDAAVACRELGCGGALAAPGGARFGPGAGPVWMDDVGCGGGEQALRDCPRSPWGRSNCDHSEDAGLVCTGPAPRLRLADGPHGCAGRLEVWHGGRWGSVCDDAWDLRDAAVACRELGCGGALAAPGGAFFGEGSGPIILDDLRCRGNETALRFCPARPWGQHDCHHREDAGAVCDGMPLGYVPPTAPTDSNNSTPREAASRPPSTMTSQAPGTAGVSPPPASPTVLWEPGPEAGSPQLRLVAGPSKCSGRLEVWHDQRWGTVCDDSWDMRDSAVVCRELGCGGPQQPDPAAGRFGWGAGPIWLDDVGCVGTEASLSDCPAAPWGKHNCAHNEDVGVTCTGPPGLDSISDPFSWSWIPGLGRDRDAWLPGELATKPSASVTASVLEKTTTKAPGKMPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGAWGKHNCDHEEDVGLTCTGYTDYDDYPPWTWDPTSREDLAKGTTTAGVPGHTLPWRTTRRPGSSSPAIRRLPDTGSKDGYKLPWTWDTPSGRGLAEGTPTAGKLGPTLGAGTTRSPGSPPTLRVHGDTGSPRKPWPERRPPRPAATRTAPPTPSPGPSASPGPPGPALTSDSSRELTPHSALTSEATSDAPDTSPPTPDPASRTNPDLILTSPDFALSTPDSSVVPALTPEPSPTPLPTLPKELTSDPSTPSEVTSLSPTSEQVPESDTTPDLDTTPYSSTVSEYSRSPDPSPSPHPTTTPDPTMAPDPITTLNPTVTPHFPTTPHPTTTPHPTTITHSTMIPDPTTTPQPFTTITHSTMIPDPTTTPQPFTTMQPTTTPHSTTPHPTTTPHPTTITHSTMIPDPTTTPQPFTTMQPTTMPHPTTTPHPTTTPHPTTTPHPTTTPHPTMTPDPTTTPYPTTTPDPTTTPHPTTPDPSSTPVITTVSLPTSLGTELSSPTLAPTVKPSLHPQLTFTAPAPHTSTSQIPTLEPSPALESSPSRSSTATSMDPLSTEDFKPPRSQSPNLTPPPTHTPHSASDLTVSPDPLLSPTAHPLDHPPLDPLTLGPTPGQSPGPHGPCVAPTPPVRVMACEPPALVELVAAVRDVGGQLQRLTQVVEQERQERQALLLGLTQLVEAARGLGQLGEAVKRLAEMAWTTSMPAPTTTTPEEEERPLRGDV

SEQ ID NO: 2624 - protein, 636 aa, Homo sapiens; identical to SEQ ID NO: 2224

SEQ ID NO: 2625 - protein, 678 aa, Homo sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 2626 - protein, 107 aa, Homo sapiens
  MOD_RES (1)..(1): Any amino acid
XTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2627 - protein, 121 aa, Homo sapiens
MVLQTQVFISLLLWISGAYGDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTP

SEQ ID NO: 2628 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2629 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 2630 - protein, 330 aa, Homo sapiens [sequence omitted]

SEQ ID NO: 2631 - protein, 216 aa, Homo sapiens; identical to SEQ ID NO: 2146

SEQ ID NO: 2632 - protein, 253 aa, Homo sapiens; identical to SEQ ID NO: 2050

SEQ ID NO: 2633 - protein, 155 aa, Homo sapiens
MFQRLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGP

SEQ ID NO: 2634 - protein, 517 aa, Homo sapiens
MAVSRKDWSALSSLARQRTLEDEEEQERERRRRHRNLSSTTDDEAPRLSQNGDRQASASERLPSVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKKGVPEKSPVLEKSSMPKKTAPEKSLVSDKTSISEKVLASEKTSLSEKIAVSEKRNSSEKKSVLEKTSVSEKSLAPGMALGSGRRLVSEKASIFEKALASEKSPTADAKPAPKRATASEQPLAQEPPASGGSPATTKEQRGRALPGKNLPSLAKQGASDPPTVASRLPPVTLQVKIPSKEEEADMSSPTQRTYSSSLKRSSPRTISFRMKPKKENSETTLTRSASMKLPDNTVKLGEKLERYHTAIRRSESVKSRGLPCTELFVAPVGVASKRHLFEKELAGQSRAEPASSRKENLRLSGVVTSRLNLWISRTQESGDQDPQEAQKASSATERTQWGQKSDSSLDAEV

SEQ ID NO: 2635 - protein, 89 aa, Homo sapiens; identical to SEQ ID NO: 2110

SEQ ID NO: 2636 - protein, 433 aa, Homo sapiens
MGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 2637 - protein, 654 aa, Homo sapiens; identical to SEQ ID NO: 2009

SEQ ID NO: 2638 - protein, 390 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQGFRGQGVSSNMRNSETSPGMFNFDTFWKNFKSKLGFINWDAINK

SEQ ID NO: 2639 - protein, 281 aa, Homo sapiens; identical to SEQ ID NO: 2217

SEQ ID NO: 2640 - protein, 291 aa, Homo sapiens
VLSASGPGRKMGSRGQGLLLAYCLLLAFASGLVLSRVPHVQGEQQEWEGTEELPSPPDHAERAEEQHEKYRPSQDQGLPASRCLRCCDPGTSMYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 2641 - protein, 333 aa, Homo sapiens
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 2642 - protein, 103 aa, Homo sapiens [sequence omitted]

SEQ ID NO: 2643 - protein, 103 aa, Homo sapiens [sequence omitted]

SEQ ID NO: 2644 - protein, 103 aa, Homo sapiens [sequence omitted]

SEQ ID NO: 2645 - protein, 103 aa, Homo sapiens [sequence omitted]

SEQ ID NO: 2646 - protein, 755 aa, Homo sapiens
MPPFLLLEAVCVFLFSRVPPSLPLQEVHVSKETIGKISAASKMMWCSAAVDIMFLLDGSNSVGKGSFERSKHFAITVCDGLDISPERVRVGAFQFSSTPHLEFPLDSFSTQQEVKARIKRMVFKGGRTETELALKYLLHRGLPGGRNASVPQILIIVTDGKSQGDVALPSKQLKERGVTVFAVGVRFPRWEELHALASEPRGQHVLLAEQVEDATNGLFSTLSSSAICSSATPDCRVEAHPCEHRTLEMVREFAGNAPCWRGSRRTLAVLAAHCPFYSWKRVFLTHPATCYRTTCPGPCDSQPCQNGGTCVPEGLDGYQCLCPLAFGGEANCALKLSLECRVDLLFLLDSSAGTTLDGFLRAKVFVKRFVRAVLSEDSRARVGVATYSRELLVAVPVGEYQDVPDLVWSLDGIPFRGGPTLTGSALRQAAERGFGSATRTGQDRPRRVVVLLTESHSEDEVAGPARHARARELLLLGVGSEAVRAELEEITGSPKHVMVYSDPQDLFNQIPELQGKLCSRQRPGCRTQALDLVFMLDTSASVGPENFAQMQSFVRSCALQFEVNPDVTQVGLVVYGSQVQTAFGLDTKPTRAAMLRAISQAPYLGGVGSAGTALLHIYDKVMTVQRGARPGVPKAVVVLTGGRGAEDAAVPAQKLRNNGISVLVVGVGPVLSEGLRRLAGPRDSLIHVAAYADLRYHQDVLIEWLCGEAKQPVNLCKPSPCMNEGSCVLQNGSYRCKCRDGWEGPHCENRFLRRP

SEQ ID NO: 2647 - protein, 271 aa, Homo sapiens
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQEKMGSCRFHGS

SEQ ID NO: 2648 - protein, 464 aa, Homo sapiens
MEHSVCPSSAVHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 2649 - protein, 480 aa, Homo sapiens; identical to SEQ ID NO: 1981

SEQ ID NO: 2650 - protein, 436 aa, Homo sapiens; identical to SEQ ID NO: 2285

SEQ ID NO: 2651 - protein, 386 aa, Homo sapiens; identical to SEQ ID NO: 2394

SEQ ID NO: 2652 - protein, 329 aa, Homo sapiens
MRPPPALALAGLCLLALPAAAASYFGLTGREVLTPFPGLGTAAAPAQGGAHLKQCDLLKLSRRQKQLCRREPGLAETLRDAAHLGLLECQFQFRHERWNCSLEGRMGLLKRGFKETAFLYAVSSAALTHTLARACSAGRMERCTCDDSPGLESRQAWQWGVCGDNLKYSTKFLSNFLGSKRGNKDLRARADAHNTHVGIKAVKSGLRTTCKCHGVSGSCAVRTCWKQLSPFRETGQVLKLRYDSAVKVSSATNEALGRLELWAPARQGSLTKGLAPRSGDLVYMEDSPSFCRPSKYSPGTAGWSAVARSQLITTSTSRIQAILPSQLPE

SEQ ID NO: 2653 - protein, 192 aa, Homo sapiens
MRLAGPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 2654 - protein, 350 aa, Homo sapiens; identical to SEQ ID NO: 2243

SEQ ID NO: 2655 - protein, 62 aa, Homo sapiens
MKIQLFFFILHFWVTILPARSNFEPKYRFERCEKVRGICKTFCDDVEYDYGYCIKWRSQCCV

SEQ ID NO: 2656 - protein, 245 aa, Homo sapiens
MTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYVCQYCPAGNWANRLYVPYEQGAPCASCPDNCDDGLCTNGCKYEDLYSNCKSLKLTLTCKHQLVRDSCKASCNCSNSIY

SEQ ID NO: 2657 - protein, 446 aa, Homo sapiens; identical to SEQ ID NO: 1982

SEQ ID NO: 2658 - protein, 194 aa, Homo sapiens; identical to SEQ ID NO: 1914

SEQ ID NO: 2659 - protein, 194 aa, Homo sapiens; identical to SEQ ID NO: 1914

SEQ ID NO: 2660 - protein, 115 aa, Homo sapiens
MTMRHNWTPDLSPLWVLLLCAHVVTLLVRATPVSQTTTAATASVRSTKDPCPSQPPVFPAAKQCPALEVTWPEVEVPLSWAEGNLAPHPRSPALQPQQSTAAGLRLSTGPAAAQP

SEQ ID NO: 2661 - protein, 175 aa, Homo sapiens; identical to SEQ ID NO: 2053

SEQ ID NO: 2662 - protein, 330 aa, Homo sapiens
MGKLCLGPTLCPAAAAEESRDAEPRRELLCSGRPWTWRAAARVTTMIPWVLLACALPCAADPLLGAFARRDFRKGSPQLVCSLPGPQGPPGPPGAPGPSGMMGRMGFPGKDGQDGHDGDRGDSGEEGPPGRTGNRGKPGPKGKAGAIGRAGPRGPKGVNGTPGKHGTPGKKGPKGKKGEPGLPGPCSCGSGHTKSAFSVAVTKSYPRERLPIKFDKILMNEGGHYNASSGKFVCGVPGIYYFTYDITLANKHLAIGLVHNGQYRIRTFDANTGNHDVASGSTILALKQGDEVWLQIFYSEQNGLFYDPYWTDSLFTGFLIYADQDDPNEV

SEQ ID NO: 2663 - protein, 129 aa, Homo sapiens
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGLGLQG

SEQ ID NO: 2664 - protein, 408 aa, Homo sapiens
MFSNANSRSKMWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 2665 - protein, 130 aa, Homo sapiens; identical to SEQ ID NO: 2203

SEQ ID NO: 2666 - protein, 130 aa, Homo sapiens; identical to SEQ ID NO: 2203

SEQ ID NO: 2667 - protein, 576 aa, Homo sapiens
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDNDQEPPYSMITLHEMAETDEGWLDVVQSLIRVIPLEDPLGPAVITLLLDECPLPTKDALQKLTEILNLNGEVACQDSSHPAKHRNTSAVLGCLAEKLAGPASIGLLSPGILEYLLQCLKLQSHPTVMLFALIALEKFAQTSENKLTISESSISDRLVTLESWANDPDYLKRQVGFCAQWSLDNLFLKEGRQLTYEKVNLSSIRAMLNSNDVSEYLKISPHGLEARCDASSFESVRCTFCVDAGVWYYEVTVVTSGVMQIGWATRDSKFLNHEGYGIGDDEYSCAYDGCRQLIWYNARSKPHIHPCWKEGDTVGFLLDLNEKQMIFFLNGNQLPPEKQVFSSTVSGFFAAASFMSYQQCEFNFGAKPFKYPPSMKFSTFNDYAFLTAEEKIILPRHRRLALLKQVSIRENCCSLCCDEVADTQLKPCGHSDLCMDCALQLETCPLCRKEIVSRIRQISHIS

SEQ ID NO: 2668 - protein, 119 aa, Homo sapiens
MARPGMERWRDRLALVTGASGGIGAAVARALVQQGLKVVGCARTVGNIEELAAECKSAGYPGTLIPYRCDLSNEEDILSMFSAIRSQHSGVDICINNAGLARPDTLLSGSTSGWKDMFN

SEQ ID NO: 2669 - protein, 47 aa, Homo sapiens
MQVSTAALAVLLCTMALCNQVLSAPQAGRSVLTPVRSGSRNTSVTWS

SEQ ID NO: 2670 - protein, 52 aa, Homo sapiens
MQVSTAALAVLLCTMALCNQVLSAPLSRPREAGRSVLTPVRSGSRNTSVTWS

SEQ ID NO: 2671 - protein, 423 aa, Homo sapiens
MELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDVDNILIPENRAHLSPEVQLKELLEKLDLVSAMRSSGARTRRVRLLRREINALRQKLAQPPPPQPPSLNKTVSNGELPAGPQGDAAVLEQALQEEPEDDGDRDDSKLPPPPTLEPTGPAPSLSEQESPPEPPTLKPINDSKPPSRFLKPRKVEEDELLEKSPLQLGNEPLQRLLSDNGINRLSLMAPDTPAGTPLSGVGRRTSVLFKKAKNGVKLQRSPDRVLENGEDHGVAGSPASPASIEEERHSRKRPRSRSCSESEGERSPQQEEETGMTNGFGKHRKRV

SEQ ID NO: 2672 - protein, 1009 aa, Homo sapiens
MGSGRVPGLCLLVLLVHARAAQYSKAAQDVDECVEGTDNCHIDAICQNTPRSYKCICKSGYTGDGKHCKDVDECEREDNAGCVHDCVNIPGNYRCTCYDGFHLAHDGHNCLDVDECAEGNGGCQQSCVNMMGSYECHCREGFFLSDNQHTCIQRPEEGMNCMNKNHGCAHICRETPKGGIACECRPGFELTKNQRDCKLTCNYGNGGCQHTCDDTEQGPRCGCHIKFVLHTDGKTCIGERRLEQHIPTQAVSNETCAVNNGGCDSKCHDAATGVHCTCPVGFMLQPDRKTCKDIDECRLNNGGCDHICRNTVGSFECSCKKGYKLLINERNCQDIDECSFDRTCDHICVNTPGSFQCLCHRGYLLYGITHCGDVDECSINRGGCRFGCINTPGSYQCTCPAGQGRLHWNGKDCTEPLKCQGSPGASKAMLSCNRSGKKDTCALTCPSRARFLPESENGFTVSCGTPSPRAAPARAGHNGNSTNSNHCHEAAVLSIKQRASFKIKDAKCRLHLRNKGKTEEAGRITGPGGAPCSECQVTFIHLKCDSSRKGKGRRARTPPGKEVTRLTLELEAEVRAEETTASCGLPCLRQRMERRLKGSLKMLRKSINQDRFLLRLAGLDYELAHKPGLVAGERAEPMESCRPGQHRAGTKCVSCPQGTYYHGQTEQCVPCPAGTFQEREGQLSCDLCPGSDAHGPLGATNVTTCAGQCPPGQHSVDGFKPCQPCPRGTYQPEAGRTLCFPCGGGLTTKHEGAISFQDCDTKVQCSPGHYYNTSIHRCIRCAMGSYQPDFRQNFCSRCPGNTSTDFDGSTSVAQCKNRQCGGELGEFTGYIESPNYPGNYPAGVECIWNINPPPKRKILIVVPEIFLPSEDECGDVLVMRKNSSPSSITTYETCQTYERPIAFTARSRKLWINFKTSEANSARGFQIPYVTYDEDYEQLVEDIVRDGRLYASENHQEILKDKKLIKAFFEVLAHPQNYFKYTEKHKEMLPKSFIKLLRSKVSSFLRPYK

SEQ ID NO: 2673 - protein, 327 aa, Homo sapiens
MTALELARRGARVVLACRSQERGEAAAFDLRQESGNNEVIFMALDLASLASVRAFATAFLSSEPRLDILIHNAGISSCGRTREAFNLLLRVNHIGPFLLTHLLLPCLKACAPSRVVVVASAAHCRGRLDFKRLDRPVVGWRQELRAYADTKLANVLFARELANQLEATGVTCYAAHPGPVNSELFLRHVPGWLRPLLRPLAWLVLRAPRGGAQTPLYCALQEGIEPLSGRYFANCHVEEVPPAARDDRAAHRLWEASKRLAGLGPGEDAEPDEDPQSEDSEAPSSLSTPHPEEPTVSQPYPSPQSSPDLSKMTHRIQAKVEPEIQLS

SEQ ID NO: 2674 - protein, 439 aa, Homo sapiens; identical to SEQ ID NO: 1970

SEQ ID NO: 2675 - protein, 1228 aa, Homo sapiens; identical to SEQ ID NO: 1931

SEQ ID NO: 2676 - protein, 531 aa, Homo sapiens
MKGARLFVLLSSLWSGGIGLNNSKHSWTIPEDGNSQKTMPSASVPPNKIQSLQILPTTRVMSAEIATTPEKAEGVVKLQNLTLPTNASIKFNPGAESVVLSNSTLKFLQSFARKSNEQATSLNTVGGTGGIGGVGGTGGVGNRAPRETYLSRGDSSSSQRTDYQKSNFETTRGKNWCAYVHTRLSPTVILDNQVTYVPGGKGPCGWTGGSCPQRSQKISNPVYRMQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKEEYSSCSRHPCQNGGTCINGRTSFTCACRHPFTGDNCTIKLVEENALAPDFSKGSYRYAPMVAFFASHTYGMTIPGPILFNNLDVNYGASYTPRTGKFRIPYLGVYVFKYTIESFSAHISGFLVVDGIDKLAFESENINSEIHCDRVLTGDALLELNYGQEVWLRLAKGTIPAKFPPVTTFSGYLLYRT

SEQ ID NO: 2677 - protein, 313 aa, Homo sapiens; identical to SEQ ID NO: 2235

SEQ ID NO: 2678 - protein, 277 aa, Homo sapiens
MCTVVDPRIVRRYLLRRQLGQGAYGIVWKAVDRRTGEVVAIKKIFDAFRDKTDAQRTFREITLLQEFGDHPNIISLLDVIRAENDRDIYLVFEFMGCPPSPPPPTAVRTLSADTDLNAVIRKGGLLQDVHVRSIFYQLLRATRFLHSGHVVHRDQKPSNVLLDANCTVKLCDFGLARSLGDLPEGPEDQAVTEYVATRWYRAPEVLLSSHRYTLGVDMWSLGCILGEMLRGRPLFPGTSTLHQLELILETIPPPSEEDLLALGSGCRASVLHQLGSR

SEQ ID NO: 2679 - protein, 254 aa, Homo sapiens
MCTVVDPRIVRRYLLRRQLGQGAYGIVWKAVDRRTGEVVAIKKIFDAFRDKTDAQRTFREITLLQEFGDHPNIISLLDVIRAENDRDIYLVFEFMDTDLNAVIRKGGLLQDVHVRSIFYQLLRATRFLHSGHVVHRDQKPSNVLLDANCTVKLCDFGLARSLGDLPEGPEDQAVTEYVATRWYRAPEVLLSSHRYTLGVDMWSLGCILGEMLRGRPLFPGTSTLHQLELILETIPPPSEEGAQTACRSGTGAST

SEQ ID NO: 2680 - protein, 157 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIERHLAPGSWGGGQLSREGPSLAPEGSMPSPRGDLP

SEQ ID NO: 2681 - protein, 232 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMRPRSSAFSWPGTHRATPAFLVSPALRCLEPPHLANLTLEDAAECLKQH

SEQ ID NO: 2682 - protein, 131 aa, Homo sapiens
MGGDGRYVLNGHWVVSPPGTYEAAGTHVVYTRDTGPQETLQAAGPTSHDLLLQVLLQEPNPGIEFEFWLPRERYSPFQARVQALGWPLRQPQPRGVEPQPPAAPAVTPAQTPTLAPGPSAGPPPPGPGDPL

SEQ ID NO: 2683 - protein, 148 aa, Homo sapiens
MARIPTAALGCISLLCLQLPGSLSRSLGGDPRPVKPREPPARSPSSSLQPRHPAPRPVVWKLHRALQAQRGAGLAPVMGQPLRDGGRQHSGPRRHSGPRRTQAQLLRVGCVLGTCQVQNLSHRLWQLMGPAGRQDSAPVDPSSPHSYG

SEQ ID NO: 2684 - protein, 148 aa, Homo sapiens; identical to SEQ ID NO: 2683

SEQ ID NO: 2685 - protein, 178 aa, Homo sapiens
MDRAARCSGASSLPLLLALALGLVILHCVVADGNSTRSPETNGLLCGDPEENCAATTTQSKRKGHFSRCPKQYKHYCIKGRCRFVVAEQTPSCVCDEGYIGARCERVDLFYLRGDRGQILVICLIAVMVVFIILVIGVCTCCHPLRKRRKRKKKEEEMETLGKDITPINEDIEETNIA

SEQ ID NO: 2686 - protein, 416 aa, Homo sapiens
MSISLSSLILLPIWINMAQIQQGGPDEKEKTTALKDLLSRIDLDELMKKDEPPLDFPDTLEGFEYAFNEKGQLRHIKTGEPFVFNYREDLHRWNQKRYEALGEIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 2687 - protein, 279 aa, Homo sapiens
MKIIILLGFLGATLSAPLIPQRLMSASNSNELLLNLNNGQLLPLQLQGPLNSWIPPFSGILQQQQQAQIPGLSQFSLSALDQFAGLLPNQIPLTGEASFAQGAQAGQVDPLQLQTPPQTQPGPSHVMPYVFSFKMPQEQGQMFQYYPVYMVLPWEQPQQTVPRSPQQTRQQQYEEQIPFYAQFGYIPQLAEPAISGGQQQLAFDPQLGTAPEIAVMSTGEEIPYLQKEAINFRHDSAGVFMPSTSPKPSTTNVFTSAVDQTITPELPEEKDKTDSLREP

SEQ ID NO: 2688 - protein, 147 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDP

SEQ ID NO: 2689 - protein, 205 aa, Homo sapiens
MGGPVREPALSVALWLSWGAALGAVACAMALLTQQTELQSLRREVSRLQGTGGPSQNGEGYPWQSLPEQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 2690 - protein, 247 aa, Homo sapiens
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGL

SEQ ID NO: 2691 - protein, 12 aa, Homo sapiens
MGKSESLQSLQR

SEQ ID NO: 2692 - protein, 1421 aa, Homo sapiens
MMLPQNSWHIDFGRCCCHQNLFSAVVTCILLLNSCFLISSFNGTDLELRLVNGDGPCSGTVEVKFQGQWGTVCDDGWNTTASTVVCKQLGCPFSFAMFRFGQAVTRHGKIWLDDVSCYGNESALWECQHREWGSHNCYHGEDVGVNCYGEANLGLRLVDGNNSCSGRVEVKFQERWGTICDDGWNLNTAAVVCRQLGCPSSFISSGVVNSPAVLRPIWLDDILCQGNELALWNCRHRGWGNHDCSHNEDVTLTCYDSSDLELRLVGGTNRCMGRVELKIQGRWGTVCHHKWNNAAADVVCKQLGCGTALHFAGLPHLQSGSDVVWLDGVSCSGNESFLWDCRHSGTVNFDCLHQNDVSVICSDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSDKADLDLRLVGAHSPCYGRLEVKYQGEWGTVCHDRWSTRNAAVVCKQLGCGKPLHVFGMTYFKEASGPIWLDDVSCIGNESNIWDCEHSGWGKHNCVHREDVIVTCSGDATWGLRLVGGSNRCSGRLEVYFQGRWGTVCDDGWNSKAAAVVCSQLDCPSSIIGMGLGNASTGYGKIWLDDVSCDGDESDLWSCRNSGWGNNDCSHSEDVGVICSDASDMELRLVGGSSRCAGKVEVNVQGAVGILCANGWGMNIAEVVCRQLECGSAIRVSREPHFTERTLHILMSNSGCTGGEASLWDCIRWEWKQTACHLNMEASLICSAHRQPRLVGADMPCSGRVEVKHADTWRSVCDSDFSLHAANVLCRELNCGDAISLSVGDHFGKGNGLTWAEKFQCEGSETHLALCPIVQHPEDTCIHSREVGVVCSRYTDVRLVNGKSQCDGQVEINVLGHWGSLCDTHWDPEDARVLCRQLSCGTALSTTGGKYIGERSVRVWGHRFHCLGNESLLDNCQMTVLGAPPCIHGNTVSVICTGSLTQPLFPCLANVSDPYLSAVPEGSALICLEDKRLRLVDGDSRCAGRVEIYHDGFWGTICDDGWDLSDAHVVCQKLGCGVAFNATVSAHFGEGSGPIWLDDLNCTGMESHLWQCPSRGWGQHDCRHKEDAGVICSEFTALRLYSETETESCAGRLEVFYNGTWGSVGRRNITTAIAGIVCRQLGCGENGVVSLAPLSKTGSGFMWVDDIQCPKTHISIWQCLSAPWERRISSPAEETWITCEDRIRVRGGDTECSGRVEIWHAGSWGTVCDDSWDLAEAEVVCQQLGCGSALAALRDASFGQGTGTIWLDDMRCKGNESFLWDCHAKPWGQSDCGHKEDAGVRCSGQSLKSLNASSGHLALILSSIFGLLLLVLFILFLTWCRVQKQKHLPLRDDTPNHGCEDASDTSLLGVLPASEATK

SEQ ID NO: 2693 - protein, 469 aa, Homo sapiens; identical to SEQ ID NO: 1884

SEQ ID NO: 2694 - protein, 278 aa, Homo sapiens; identical to SEQ ID NO: 2204

SEQ ID NO: 2695 - protein, 375 aa, Homo sapiens
MEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 2696 - protein, 152 aa, Homo sapiens
MRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 2697 - protein, 349 aa, Homo sapiens
MTALPGPLWLLGLALCALGGGGPGLRPPPGCPQRRLGARERRDVQREILAVLGLPGRPRPRAPPAASRLPASAPLFMLDLYHAMAGDDDEDGAPAERRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGETWTGWGWTKDSRLQMWKLRLSRTPWVLSLHAPGPAQAPAERPLLCLLQGHCPASPSPIRTPRAVRPLRRRQPKKSNELPQANRLPGIFDDVHGSHGRQVCRRHELYVSFQDLGWLVIADSSCF

SEQ ID NO: 2698 - protein, 538 aa, Homo sapiens; identical to SEQ ID NO: 2030

SEQ ID NO: 2699 - protein, 209 aa, Homo sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEG

SEQ ID NO: 2700 - protein, 538 aa, Homo sapiens; identical to SEQ ID NO: 2030

SEQ ID NO: 2701 - protein, 507 aa, Homo sapiens; identical to SEQ ID NO: 2036

SEQ ID NO: 2702 - protein, 250 aa, Homo sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSGAAASCPKADRHWQHFPVEEIFLACGFKVAGLGAAPGWGRGGKQEDRPPEEQRRAGEDFPIYQCVFIYP

SEQ ID NO: 2703 - protein, 461 aa, Homo sapiens [sequence omitted]

SEQ ID NO: 2704 - protein, 461 aa, Homo sapiens [sequence omitted]

SEQ ID NO: 2705 - protein, 461 aa, Homo sapiens [sequence omitted]

SEQ ID NO: 2706 - protein, 483 aa, Homo sapiens [sequence omitted]

SEQ ID NO: 2707 - protein, 531 aa, Homo sapiens
MCQLLESTVIQPQGDSPVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKMSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 2708 - protein, 573 aa, Homo sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAGQAYWFTPVIPALWEAEARGSLEVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 2709 - protein, 409 aa, Homo sapiens
MKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 2710 - protein, 592 aa, Homo sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKHFVLQDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 2711 - protein, 183 aa, Homo sapiens
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKGQMEPRTHPTWLLHIFIPFCIIAFIFIATVIALRKQLCQKLYSSKDTTKRPVTTTKREVNSAI

SEQ ID NO: 2712 - protein, 273 aa, Homo sapiens
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 2713 - protein, 123 aa, Homo sapiens
LGDRRGRSSGARAAAVGSTGERLEMEEDILQLQAEATAEVLGEVAQAQKVLRDSVQRLEVQLRSAWLGPAYREFEVLKAHADKQSHILWALTGHVQRQRREMVAQQHRLRQIQERLHTAALPA

SEQ ID NO: 2714 - protein, 114 aa, Homo sapiens
MASFKLADSVWEDSLSKRQRNQGRMKTLPVLVLSLTLLTVFSETSPILTEKQAKQLLRSRRQDRPSKPGFPDEPMREYMHHLLALEHRAEEQFLEHWLNPHCKPHCDRNRIHPV

SEQ ID NO: 2715 - protein, 114 aa, Homo sapiens; identical to SEQ ID NO: 2714

SEQ ID NO: 2716 - protein, 147 aa, Homo sapiens
MALQRTHSLLLLLLLTLLGLGLVQPSYGQDGMYQRFLRQHVHPEETGGSDRYCNLMMQRRKMTLYHCKRFNTFIHEDIWNIRSICSTTNIQCKNGKMNCHEGVVKVTDCRDTGSSRAPNCRYRAIASTRRVVIACEGNPQVPVHFDG

SEQ ID NO: 2717 - protein, 433 aa, Homo sapiens
MEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQGLASPLLRCPSQRLLDRVVRRYAEVADAGSIFMDHFTDRDKLRLLYTLAVNSHPILLQIFPGAEGWPLPKYLGSCGRFLVSTSTRPLQEFYDAPPDQAADLAYQLLGVLESLRSNDLNYFFYFTHIDAGMFGVFNNGHLFIRDASAVGVIDKQEGSQEANRAGENKDIFSCLVSGCQAQLPSCESISEKQSLVLVCQKLLPRLLQGRFPSPVQDDIDSILVQCGDSIRPDPEVLGAASQLKDILRPLRTCDSRFAYRYPDCKYNDKF

SEQ ID NO: 2718 - protein, 199 aa, Homo sapiens; identical to SEQ ID NO: 2193

SEQ ID NO: 2719 - protein, 199 aa, Homo sapiens; identical to SEQ ID NO: 2193

SEQ ID NO: 2720 - protein, 96 aa, Homo sapiens
MLPCLALLLLMELSVCTVAGDGGEEQTLSTEAETWEGAGPSIQLQLQEVKTGKASQFFGLMGKRVGAYQLEHTFQGLLGKRSLFTEGREDEAQGSE

SEQ ID NO: 2721 - protein, 326 aa, Homo sapiens
MTGLCGYSAPDMRGLRLIMIPVELLLCYLLLHPVDATSYGKQTNVLMHFPLSLESQTPSSDPLSCQFLHPKSLPGFSHMAPLPKFLVSLALRNALEEAGCQADVWALQLQLYRQGGVNATQVLIQHLRGLQKGRSTERNVSVEALASALQLLAREQQSTGRVGRSLPTEDCENEKEQAVHNVVQLLPGVGTFYNLGTALYYATQNCLGKARERGRDGAIDLGYDLLMTMAGMSGGPMGLAISAALKPALRSGVQQLIQYYQDQKDANISQPETTKEGLRAISDVSDLEETTTLASFISEVVSSAPYWGWAIIKSYDLDPGAGSLEI

SEQ ID NO: 2722 - protein, 491 aa, Homo sapiens
MRWILCWSLTLCLMAQTALGALHTKRPQVVTKYGTLQGKQMHVGKTPIQVFLGVPFSRPPLGILRFAPPEPPEPWKGIRDATTYPPGCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYNITKEQVPLVVEEYLDNVNEHDWKMLRNRMMDIVQDATFVYATLQTAHYHRGLSMGKEKALSLQMMKYWANFARTGNPNDGNLPCWPRYNKDEKYLQLDFTTRVGMKLKEKKMAFWMSLYQSQRPEKQRQF

SEQ ID NO: 2723 - protein, 94 aa, Homo sapiens
MAAFPHKIIFFLVCSTLTHVAFSGIFNKRDFTRWPKPRCKMYIPLDPDYNADCPNVTAPVCASNGHTFQNECFFCVEQREFHYRIKFEKYGKCD

SEQ ID NO: 2724 - protein, 133 aa, Homo sapiens
MRQRLLPSVTSLLLVALLFPGSSQARHVNHSATEALGELRERAPGQGTNGFQLLRHAVKRDLLPPRTPPYQGDVPPGIRNTICHMQQGICRLFFCHSGEKKRDICSDPWNRCCVSNTDEEGKEKPEMDGRSGI

SEQ ID NO: 2725 - protein, 187 aa, Homo sapiens
MGCCGCSGGCGSGCGGCGSGCGGCGSSCCVPICCCKPVCCCVPACSCSSCGSCGGSKGGRGSCGGSKGDCGSCGGSKGGCGSCGCSQCSCYKPCCCSSGCGSSCCQSSCCKPCCSQSSCCKPCSCSSGCGSSCCQSSCCKPCCSQSSCCKPCCCSSGCGSSCCQSSCCKPCCSQSSCCVPICCQCKI

SEQ ID NO: 2726 - protein, 187 aa, Homo sapiens
MRPLAGAPVPKRQKCDHWTPCPSDTYAYRLLSGGGRSKYAKICFEDNLLMGEQLGNVARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 2727 - protein, 82 aa, Homo sapiens
MKILCIFLTFVFTVSCGPSVPQKKTREVAERKRECQLVRGACKPECNSWEYVYYYCNVNPCCAVWEYQKPIINKITSKLHQK

SEQ ID NO: 2728 - protein, 61 aa, Homo sapiens
MKIHVFLFVLFFFLVPIATRVKCAVKDTYSCFIMRGKCRHECHDFEKPIGFCTKLNANCYM

SEQ ID NO: 2729 - protein, 351 aa, Homo sapiens
MGNLFMLWAALGICCAAFSASAWSVNNFLITGPKAYLTYTTSVALGAQSGIEECKFQFAWERWNCPENALQLSTHNRLRSATRETSFIHAISSAGVMYIITKNCSMGDFENCGCDGSNNGKTGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVVSKYYCARSPGSAQSLGKGSA

SEQ ID NO: 2730 - protein, 481 aa, Homo sapiens
MQSRLLLLGAPGGHGGPASRRMRLLLRQVVQRRPGGDRQRPEVRLLHAGSGADTGDTVNIGDVSYKLKIPKNPELVPQNYISDSLAQSVVQHLRWIMQKDLLGQDVFLIGPPGPLRRSIAMQYLELTKREVEYIALSRDTTETDLKQRREIRAGTAFYIDQCAVRAATEGRTLILEGLEKAERNVLPVLNNLLENREMQLEDGRFLMSAERYDKLLRDHTKKELDSWKIVRVSENFRVIALGLPVPRYSGNPLDPPLRSRFQARDIYYLPFKDQLKLLYSIGANVSAEKVSQLLSFATTLCSQESSTLGLPDFPLDSLAAAVQILDSFPMMPIKHAIQWLYPYSILLGHEGKMAVEGVLKRFELQDSGSSLLPKEIVKVEKMMENHVSQASVTIRIADKEVTIKVPAGTRLLSQPCASDRFIQTLSHKQLQAEMMQSHMVKDICLIGGKGCGKTVIAKNFADTLGYNIEPIMLYQHKVPHI

SEQ ID NO: 2731 - protein, 261 aa, Homo sapiens
MASLAVSNWPKPMPLIPCLSWSTASGVFTTGVLSKSINWRELEKQYYTQTVYEEEIIHMLEYCGTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFRQAIYDAFDRFLHKYAN

SEQ ID NO: 2732 - protein, 414 aa, Homo sapiens
MGVSKLDILYRRLLLTKLFIRGWGRPEDLKRLFEFRKMIGNRERCQNLVSSDYPVHIDKIEEQSDCKILDGHFVSPMAHYVPDIMPIESVIARFQFIVPKEWNSKYRPVCIHLAGTGDHHYWRRRTLMARPMIKEARMASLLLENPYYGCRKPKDQVRSSLKNVSDLFVMGGALVLESAALLHWLEREGYGPLGMTGISMGGHMASLAVSNWPKPMPLIPCLSWSTASGVFTTTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFR

SEQ ID NO: 2733 - protein, 248 aa, Homo sapiens
MKLTFFLGLLALISCFTPSESQRFSRRPYLPGQLPPPPLYRPRWVPPSPPPPYDSRLNSPLSLPFVPGRVPPSSFSRFSQAVILSQLFPLESIRQPRLFPGYPNLHFPLRPYYVGPIRILKPPFPPIPFFLAIYLPISNPEPQINITTADTTITTNPPTTATATTSTSTKPTMTISSSTVPISSTPEPATSISAATPAASTENTTQILANRPHTVLLNATVQVTTSNQTILSSPAFKSFWQKLFAIFG

SEQ ID NO: 2734 - protein, 76 aa, Homo sapiens
MGAAISQGALIAIVCNGLVGFLLLLLWVILCWACHSRSADVDSLSESSPNSSPGPCPEKAPPPQKPSHEGSYLLQP

SEQ ID NO: 2735 - protein, 511 aa, Homo sapiens; identical to SEQ ID NO: 1924

SEQ ID NO: 2736 - protein, 511 aa, Homo sapiens; identical to SEQ ID NO: 1924

SEQ ID NO: 2737 - protein, 79 aa, Homo sapiens
MKLHSLISVLLLFVTLIPKGKTGVIPGQKQCIALKGVCRDKLCSTLDDTIGICNEGKKCCRRWWILEPYPTPVPKGKSP

SEQ ID NO: 2738 - protein, 116 aa, Homo sapiens; identical to SEQ ID NO: 2491

SEQ ID NO: 2739 - protein, 180 aa, Homo sapiens
QVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEEKLQGNKAPESRT

SEQ ID NO: 2740 - protein, 404 aa, Homo sapiens
MPPFLITLFLFHSCCLRANGHLREGMTLLKTEFALHLYQSVAACRNETNFVISPAGVSLPLEILQFGAEGSTGQQLADALGYTVHDKRVKDFLHAVYATLPTSSQGTEMELACSLFVQVGTPLSPCFVEHVSWWANSSLEPADLSEPNSTAIQTSEGASRETAGGGPSEGPGGWPWEQVSAAFAQLVLVSTMSFQGTWRKRFSSTDTQILPFTCAYGLVLQVPMMHQTTEVNYGQFQDTAGHQVGVLELPYLGSAVSLFLVLPRDKDTPLSHIEPHLTASTIHLWTTSLRRARMDVFLPRFRIQNQFNLKSILNSWGVTDLFDPLKANLKGISGQDGFYVSEAIHKAKIEVLEEGTKASGATALLLLKRSRIPIFKADRPFIYFLREPNTGFVFSIGRVSNPLD

SEQ ID NO: 2741 - protein, 147 aa, Homo sapiens; identical to SEQ ID NO: 2688

SEQ ID NO: 2742 - protein, 876 aa, Homo sapiens; identical to SEQ ID NO: 1912

SEQ ID NO: 2743 - protein, 876 aa, Homo sapiens; identical to SEQ ID NO: 1912

SEQ ID NO: 2744 - protein, 913 aa, Homo sapiens; identical to SEQ ID NO: 2128

SEQ ID NO: 2745 - protein, 147 aa, Homo sapiens; identical to SEQ ID NO: 2688

SEQ ID NO: 2746 - protein, 876 aa, Homo sapiens; identical to SEQ ID NO: 1912

SEQ ID NO: 2747 - protein, 876 aa, Homo sapiens; identical to SEQ ID NO: 1912

SEQ ID NO: 2748 - protein, 876 aa, Homo sapiens; identical to SEQ ID NO: 1912

SEQ ID NO: 2749 - protein, 913 aa, Homo sapiens; identical to SEQ ID NO: 2128

SEQ ID NO: 2750 - protein, 913 aa, Homo sapiens; identical to SEQ ID NO: 2128

SEQ ID NO: 2751 - protein, 102 aa, Homo sapiens
MSVMKPCLMTIAILMILAQKTPGGLFRSHNGKSREPWNPCELYQGMCRNACREYEIQYLTCPNDQKCCLKLSVKITSSKNVKEDYDSNSNLSVTNSSSYSHI

SEQ ID NO: 2752 - protein, 88 aa, Homo sapiens
MLPDHFSPLSGDIKLSVLALVVLVVLAQTAPDGWIRRCYYGTGRCRKSCKEIERKKEKCGEKHICCVPKEKDKLSHIHDQKETSELYI

SEQ ID NO: 2753 - protein, 466 aa, Homo sapiens; identical to SEQ ID NO: 2207

SEQ ID NO: 2754 - protein, 68 aa, Homo sapiens
MKLCVTVLSLLVLVAAFCSLALSAPTKSSEWKLQGVCFQCCSGKDPIHQSCPTWTMVRQRKMPTTGKG

SEQ ID NO: 2755 - protein, 139 aa, Homo sapiens
MYKLASCCLLFIGFLNPLLSLPLLDSREISFQLSAPHEDARLTPEELERASLLQILPEMLGAERGDILRKADSSTNIFNPRGNLRKFQDFSGQDPNILLSHLLARIWKPYKKQRRKLRQDLRLWKKEPGLRIFKNYVYI

SEQ ID NO: 2756 - protein, 657 aa, Homo sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLDCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 2757 - protein, 1324 aa, Homo sapiens
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSQPTASAQLENMEEAPKRVSLALQLPEHGSKDIGSESAALVGTLGLTDCSQGP

SEQ ID NO: 2758 - protein, 243 aa, Homo sapiens
MGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGMETHFEPFILPLTNAPQKGQSYRVDRFMNGDF

SEQ ID NO: 2759 - protein, 405 aa, Homo sapiens; identical to SEQ ID NO: 2248

SEQ ID NO: 2760 - protein, 190 aa, Homo sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQADLWSTATYTSSQNRPRADPVQRQPCYSL

SEQ ID NO: 2761 - protein, 132 aa, Homo sapiens
MAPSPRTGSRQDATALPSMSSTFWAFMILASLLIAYCSQLAAGTCEIVTLDRDSSQPRRTIARQTARCACRKGQIAGTTRARPACVDARIIKTKQWCDMLPCLEGEGCDLLINRSGWTCTQPGGRIKTTTVS

SEQ ID NO: 2762 - protein, 318 aa, Homo sapiens; identical to SEQ ID NO: 2081

SEQ ID NO: 2763 - protein, 132 aa, Homo sapiens
MLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPGNLDARLDGGEKAMQPQW

SEQ ID NO: 2764 - protein, 243 aa, Homo sapiens
MLLSLLGACAVVGPFHGPEWEPVQGLLSQNHSCRDPQCCGNLLVLCLFLVWQVRHCWHQVTRTRFSTRNVIKVPLQKRAVPSMRCETVFKLTPEFFSPGKSRGLDSQQCAQRQRWGYRRSLQESWAQNLLSPQHPCPGPPSGVHTHSEPIFCTTSISNTCLLPQNSSWKAWQVPWCLHDGQTRPALDMCQEMEQLLLHSQERLVSLEPVISVRSRPTSMTLTTSLPNLLSAERLQFCPQRAPA

SEQ ID NO: 2765 - protein, 834 aa, Homo sapiens; identical to SEQ ID NO: 2097

SEQ ID NO: 2766 - protein, 394 aa, Homo sapiens
MWRCPLGLLLLLPLAGHLALGAQQGRGRRELAPGLHLRGIRDAGGRYCQEQDLCCRGRADDCALPYLGAICYCDLFCNRTVSDCCPFPPIQGCMHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITG

SEQ ID NO: 2767 - protein, 100 aa, Homo sapiens
MAAALALVAGVLSGAVLPLWSALPQYKKKITDRCFHHSECYSGCCLMDLDSGGAFCAPRARITMICLPQTKGATNIICPCRMGLTCISKDLMCSRRCHMI

SEQ ID NO: 2768 - protein, 325 aa, Homo sapiens
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 2769 - protein, 152 aa, Homo sapiens
MRGPGHPLLLGLLLVLGAAGRGRGGAEPREPADGQALLRLVVELVQELRKHHSAEHKGLQLLGRDCALGRAEAAGLGPSPEQRVEIVPRDLRMKDKFLKHLTGPLYFSPKCSKHFHRLYHNTRDCTIPAYYKRCARLLTRLAVSPVCMEDKQ

SEQ ID NO: 2770 - protein, 136 aa, Homo sapiens [sequence omitted]

SEQ ID NO: 2771 - protein, 402 aa, Homo sapiens
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTVRTGLSDSYPPCCLSLGCWRGVGHAWIRGRNTHTQPGYSSRVWIAAFSPACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 2772 - protein, 210 aa, Homo sapiens
MSAGKMMRTLITTHPLPLLLLPQQLLQLVQFQEVDTDFDFPEEDKKEEFEECLEKFFSTGPARPPTKEKVKRRVLIEPGMPLNHIEYCNHEIMGKNVYYKHRWVAEHYFLLMQYDELQKICYNRFVPCKNGIRKCNRSKGLVEGVYCNLTEAFEIPACKYESLYRKGYVLITCSWQNEMQKRIPHTINDLVEPPEHRSFLSEDGVFVISP

SEQ ID NO: 2773 - protein, 194 aa, Homo sapiens; identical to SEQ ID NO: 1914

SEQ ID NO: 2774 - protein, 1352 aa, Homo sapiens
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSHVPGNCSENPCQNGGTCVPGADAHSCDCGPGFKGRRCELACIKVSRPCTRLFSETKAFPVWEGGVCHHVKQSKSQTLEKS

SEQ ID NO: 2775 - protein, 318 aa, Homo sapiens; identical to SEQ ID NO: 2081

SEQ ID NO: 2776 - protein, 271 aa, Homo sapiens
MQAACWYVLFLLQPTVYLVTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITGKIVDHGNGTFSVYFRHNSTGQGNVSVSLVPPTKIVEFDLAQQTVIDAKDSKSFNCRIEYEKVDKATKNTLCNYDPSKTCYQEQTQSHVSWLCSKPFKVICIYISFYSTDYKLVQKVCPDYNYHSDTPYFPSG

SEQ ID NO: 2777 - protein, 332 aa, Homo sapiens
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFERLMSINYLGSVYPSRAVITTMKERRVGRIVFVSSQAGQLGLFGFTAYSASKFAIRGLAEALQMEVKPYNVYITVAYPPDTDTPGFAEENRTKPLETRLISETTSVCKPEQVAKQIVKDAIQGNFNSSLGSDGYMLSALTCGMAPVTSITEGLQQVVTMGLFRTIALFYLGSFDSIVRRCMMQREKSENADKTA

SEQ ID NO: 2778 - protein, 498 aa, Homo sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPDRLPSAEAQLLPPELYNPNFQEEEDEGGDENAPGSPSFDQPHKTCCPDLNSFIEIKVEKDE

SEQ ID NO: 2779 - protein, 321 aa, Homo sapiens
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVDVDECAAEPPPCSAAQFCKNANGSYTCEDVDECSLAEKTCVRKNENCYNTPGSYVCVCPDGFEETEDACVPPAEAEATEGESPTQLPSREDL

SEQ ID NO: 2780 - protein, 236 aa, Homo sapiens
MMGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGARIATSHGLSVLLLVCGFVKGALL

SEQ ID NO: 2781 - protein, 90 aa, Homo sapiens
MNMKPATASALLLLLLGLAWTQGSHGWGADASSLQKRAGRDDQNYNYNQHAYPTAYGGKYSVKTPAKGGVSPSSSASRVQPGLLQWVKFW

SEQ ID NO: 2782 - protein, 119 aa, Homo sapiens
MPAVFMLASSSALQCGRGVPRFPRTEVGAGHSVNEETKAEKVGNQTSVIPATSRQAALGTSWTQRRTQPLQERSHWHPRGNNASGMGGHRMFPGPLRGPAAQVLENECGSLGRAAEGRS

SEQ ID NO: 2783 - protein, 212 aa, Homo sapiens; identical to SEQ ID NO: 2170

SEQ ID NO: 2784 - protein, 128 aa, Homo sapiens
MRVARRTRNVCRCPRAAGPGVPEPRAAPLPLLAMAPPPACRSPMSPPPPPLLLLLLSLALLGARARAEPAGSAVPAQSRPCVDCHAFEFMQRALQDLRKTACSLDARTETLLLQAERRALCACWPAGH

SEQ ID NO: 2785 - protein, 132 aa, Homo sapiens
MGPRVLQPPLLLLLLALLLAALPCGAEEASPLRPAQVTLSPPPAVTNGSQPGAPHNSTHTRPPGASGSALTRSFYVILGFCGLTALYFLIRAFRLKKPQRRRYGLLANTEDPTEMASLDSDEETVFESRNLR

SEQ ID NO: 2786 - protein, 194 aa, Homo sapiens; identical to SEQ ID NO: 2066

SEQ ID NO: 2787 - protein, 146 aa, Homo sapiens
MVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 2788 - protein, 77 aa, Homo sapiens
MGSSGLLSLLVLFVLLANVQGPGLTDWLFPRRCPKIREECEFQERDVCTKDRQCQDNKKCCVFSCGKKCLDLKQGKQ

SEQ ID NO: 2789 - protein, 147 aa, Homo sapiens
MGQEVHGSCWALGAGGGQRQWVGRSMPPLAPQLCRAVFLVPILLLLQVKPLNGSPGPKDGSQTEKTPSADQNQEQFEEHFVASSVGEMWQVVDMAQQEEDQSSKTAAVHKHSFHLSFCFSLASVMVFSGGPLRRTFPNIQLCFMLTH

SEQ ID NO: 2790 - protein, 564 aa, Homo sapiens; identical to SEQ ID NO: 2292

SEQ ID NO: 2791 - protein, 140 aa, Homo sapiens; identical to SEQ ID NO: 2064

SEQ ID NO: 2792 - protein, 175 aa, Homo sapiens; identical to SEQ ID NO: 2053

SEQ ID NO: 2793 - protein, 126 aa, Homo sapiens; identical to SEQ ID NO: 2005

SEQ ID NO: 2794 - protein, 95 aa, Homo sapiens
MAPPPACRSPMSPPPPPLLLLLLSLALLGARARAEPAGSAVPAQSRPCVDCHAFEFMQRALQDLRKTACSLDARTETLLLQAERRALCACWPAGH

SEQ ID NO: 2795 - protein, 140 aa, Homo sapiens; identical to SEQ ID NO: 2064

SEQ ID NO: 2796 - protein, 96 aa, Homo sapiens; identical to SEQ ID NO: 2321

SEQ ID NO: 2797 - protein, 225 aa, Homo sapiens
  MOD_RES (1)..(1): Any amino acid
XADLPSCWGAGPCYTGHKVGALRRDTVICCCRHGDYSTPCLFTPGKPSRNPSPWKRTLWTLSAPWAGPAGWTGEEQNATKTGLITRRPRPLRRRPHPAPASPLPEIIRGNIPRMLGKFVPVNWEPPQPLPFPKYLRCYRCLLETKELGCLLGSDICLTPAGSSCITLHKKNSSGSDVMVSDCRSKEQMSDCSNTRTSPVSGFWIFSQYCFLDFCNDPQNRGLYTP

SEQ ID NO: 2798 - protein, 227 aa, Homo sapiens
MGAVMGTFSSLQTKQRRPSKDIAWWYYQYQRDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 2799 - protein, 181 aa, Homo sapiens
MQVNFVSYVQLTSRALPSLTDSKGSLVVVSSLLGRVPTSFSTPYSAAKFALDGFFGSLRRELDVQDVNVAITMCVLGLRDRASAAEAVRSSTSRPRQPEHRGVPLQSQTAMFLPPTVPGARTLTETPLRGWPQPKMKSSRQKSKTEKNDGHLEPVTAWEVQVPRVRRLCRGLARPHLFGHD

SEQ ID NO: 2800 - protein, 140 aa, Homo sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTT

SEQ ID NO: 2801 - protein, 58 aa, Homo sapiens
MGPEALSSLLLLLLVASGDADMKGHFDPAKCRYALGMQDRTIPDSDISASSSWSDSTA

SEQ ID NO: 2802 - protein, 913 aa, Homo sapiens; identical to SEQ ID NO: 2128

SEQ ID NO: 2803 - protein, 381 aa, Homo sapiens
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKDMVTYFMNLSQANAQGTPRWELEYQSTLQRYYVYNSVSYSAGVCDEACSMQHVCAMRQVDIDAYTTCLYASGTTPVPQLPLLLMALLGLCTLVL

SEQ ID NO: 2804 - protein, 151 aa, Homo sapiens
MRVAGAAKLVVAVAVFLLTFYVISQVFEIKMDASLGNLFARSALDTAARSTKPPRYKCGISKACPEKHFAFKMASGAANVVGPKICLEDNVLMSGVKNNVGRGINVALANGKTGEVLDTKYFDMWGGDVAPFIEFLKAIQDGTIVLMGTYD

SEQ ID NO: 2805 - protein, 311 aa, Homo sapiens
  MOD_RES (1)..(1): Any amino acid
XAPSPCSHFNCGSQVTDGGTIKQKIFTFDAMFSTNYSHMENYRKREDLVYQSTVRLPEVRISDNGPYECHVGIYDRATREKVVLASGNIFLNVMAPPTSIEVVAADTPAPFSRYQAQNFTLVCIVSGGKPAPMVYFKRDGEPIDAVPLSEPPAASSGPLQDSRPFRSLLHRDLDDTKMQKSLSLLDAENRGGRPYTERPSRGLTPDPNILLQPTTENIPETVVSREFPRWVHSAEPTYFLRHSRTPSSDGTVEVRALLTWTLNPQIDNEALFSCEVKHPALSMPMQAEVTLVAPKGPKIVMTPSRARVGDT

SEQ ID NO: 2806 - protein, 325 aa, Homo sapiens; identical to SEQ ID NO: 1911

SEQ ID NO: 2807 - protein, 318 aa, Homo sapiens
MGLHLRPYRVGLLPDGLLFLLLLLMLLADPALPAGRHPPVVLGWFTTKHPGPPSFLMVWMYVSLALGRPSHWSSWTPAKAAWVPISTPWWRALWAGATHGVRMSEGLPMTGAEPQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 2808 - protein, 524 aa, Homo sapiens
YALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLETPMNASSSHSCALETSPYVSTPMEATGAGPTRSAVGATSPTRMAQPAWGLSASHRAPAPPPPPLLLPLPLLLPLLELPLLHRSS

SEQ ID NO: 2809 - protein, 211 aa, Homo sapiens
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTDDGCLENTPDTAEFSREFQLHQHLFDPEHDYPGLGKWNKKLLYEKMKGGERRKRRSVNPYLQGQRLDNVVAKKSVPHFSDEDKDPE

SEQ ID NO: 2810 - protein, 154 aa, Homo sapiens
MALGVPISVYLLFNAMTALTEEAAVTVTPPITAQQGNWTVNKTEADNIEGPIALKFSHLCLEDHNSYCINGACAFHHELEKAICRCFTGYTGERCEHLTLTSYAVDSYEKYIAIGIGVGLLLSGFLVIFYCYIRKRCLKLKSPYNVCSGERRPL

SEQ ID NO: 2811 - protein, 481 aa, Homo sapiens
MGKLRPGRVEWLASGHTERPHLFQNLLLFLWALLNCGLGVSAQGPGEWTPWVSWTRCSSSCGRGVSVRSRRCLRLPGEEPCWGDSHEYRLCQLPDCPPGAVPFRDLQCALYNGRPVLGTQKTYQWVPFHGAPNQCDLNCLAEGHAFYHSFGRVLDGTACSPGAQGVCVAGRCLSAGCDGLLGSGALEDRCGRCGGANDSCLFVQRVFRDAGAFAGYWNVTLIPEGARHIRVEHRSRNHLALMGGDGRYVLNGHWVVSPPGTYEAAGTHVVYTRDTGPQETLQAAGPTSHDLLLQVLLQEPNPGIEFEFWLPRERYSPFQARVQALGWPLRQPQPRGVEPQPPAAPAVTPAQTPTLAPDPCPPCPDTRGRAHRLLHYCGSDFVFQARVLGHHHQAQETRYEVRIQLVYKNRSPLRAREYVWAPGHCPCPMLAPHRDYLMAVQRLVSPDGTQDQLLLPHAGYARPWSPAEDSRIRLTARRCPG

SEQ ID NO: 2812 - protein, 208 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWS

SEQ ID NO: 2813 - protein, 493 aa, Homo sapiens
SEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTPLPVSPMALRCCSPIQPTASFWPLTPVPLEARAPPHPPGPNPPTPRGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLN

SEQ ID NO: 2814 - protein, 772 aa, Homo sapiens
MQFQLTLFLHLGWLSYSKAQDDCNRGACHPTTGDLLVGRNTQLMASSTCGLSRAQKYCILSYLEGEQKCFICDSRFPYDPYDQPNSHTIENVIVSFEPDREKKWWQSENGLDHVSIRLDLEALFRFSHLILTFKTFRPAAMLVERSTDYGHNWKVFKYFAKDCATSFPNITSGQAQGVGDIVCDSKYSDIEPSTGGEVVLKVLDPSFEIENPYSPYIQDLVTLTNLRINFTKLHTLGDALLGRRQNDSLDKYYYALYEMIVRGSCFCNGHASECRPMQKMRGDVFSPPGMVHGQCVCQHNTDGPNCERCKDFFQDAPWRPAADLQDNACRSCSCNSHSSRCHFDMTTYLASGGLSGGVCEDCQHNTEGQHCDRCRPLFYRDPLKTISDPYACIPCECDPDGTISGGICVSHSDPALGSVAGQCLCKENVEGAKCDQCKPNHYGLSATDPLGCQPCDCNPLGSLPFLTCDVDTGQCLCLSYVTGAHCEECTVGYWGLGNHLHGCSPCDCDIGGAYSNVCSPKNGQCECRPHVTGRSCSEPAPGYFFAPLNFYLYEAEEATTLQGLAPLGSETFGQSPAVHVVLGEPVPGNPVTWTGPGFARVLPGAGLRFAVNNIPFPVDFTIAIHYETQSAADWTVQIVVNPPGGSEHCIPKTLQSKPQSFALPAATRIMLLPTPICLEPDVQYSIDVYFSQPLQGESHAHSHVLVDSAAVQWHNLGSLQPPPPECKQFSCFSFPSSWDYRHPPPHLANFCIFSRDGVSPHWPGWSQTPDLR

SEQ ID NO: 2815 - protein, 456 aa, Homo sapiens
MGRAGAAAVIPGLALLWAVGLGSAAPSPHLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRQACAPARPLAPSVPPRTSQTMSSSLRGTTPSCTTLSCPLGGALFSYKLEPITPSLKLPRTGLQPLTDTMTSSSLAQTLARC

SEQ ID NO: 2816 - protein, 110 aa, Homo sapiens
LFMLHKIVQVYNSDVIDKQSASMTSDNADDKAVIILVPVRLGGERTNTDYLEFVKGILSLEYCVGIIGGKPKQSYYFAGFQDDSLIYMDPHYCQSFVDVSIKDFPLEVIL

SEQ ID NO: 2817 - protein, 139 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQE

SEQ ID NO: 2818 - protein, 189 aa, Homo sapiens
MLGITSCSDQQAKEGEGLEGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 2819 - protein, 145 aa, Homo sapiens; identical to SEQ ID NO: 2436

SEQ ID NO: 2820 - protein, 87 aa, Homo sapiens
CKRKPYLLPSIREGARLGIQECGSQFRHERWNCMITAAATTAPMGASPLFGYELSSGCRQVDVSRLPLPRSFRLLCCENMLENHVFF

SEQ ID NO: 2821 - protein, 844 aa, Homo sapiens; identical to SEQ ID NO: 2289

SEQ ID NO: 2822 - protein, 876 aa, Homo sapiens; identical to SEQ ID NO: 1912

SEQ ID NO: 2823 - protein, 313 aa, Homo sapiens; identical to SEQ ID NO: 2235

SEQ ID NO: 2824 - protein, 280 aa, Homo sapiens
MKTFTWTLGVLFFLLVDTGHCRGGQFKIKKINQRRYPRTIKDMITRMDLENLKDVLSRQKREIDVLQLVVDVDGNIVNEVKLLRKESRNMNSRVTQLYMQLLHEIIRKRDNSLELSQLENKILNVTTEMLKMATRYRELEVKYASLTDLVNNQSVMITLLEEQCLRIFSRQDTHVSPPLVQVVPQHIPNSQQYTPGLLGGNEIQRDPGYPRDLMPPPDLATSPTKSPFKIPPVTFINEGPFKDCQQAKEAGHSVNGIFWAEYRGGSYSLRAVQMMIKPID

SEQ ID NO: 2825 - protein, 173 aa, Homo sapiens; identical to SEQ ID NO: 2208

SEQ ID NO: 2826 - protein, 102 aa, Homo sapiens
MERGAGAKLLPLLLLLRATGFTCAQTDGRNGYTAVIEVTSGGPWGDWAWPEMCPDGFFASGFSLKVEPPQGIPGDDTALNGIRLHCARGNVLGNTHVLGRME

SEQ ID NO: 2827 - protein, 116 aa, Homo sapiens; identical to SEQ ID NO: 2491

SEQ ID NO: 2828 - protein, 378 aa, Homo sapiens
  MOD_RES (1)..(1): Any amino acid
XYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNASFSLFSRNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 2829 - protein, 313 aa, Homo sapiens; identical to SEQ ID NO: 2235

SEQ ID NO: 2830 - protein, 139 aa, Homo sapiens; identical to SEQ ID NO: 2817

SEQ ID NO: 2831 - protein, 113 aa, Homo sapiens
MDNVQPKIKHRPFCFSVKGHVKMLRLALTVTSMTFFIIAQAPEPYIVITGFEVTVILFFILLYVLRLDRLMKWLFWPLLDIINSLVTTVFMLIVSVLALIPETTTLTVGGGLF

SEQ ID NO: 2832 - protein, 154 aa, Homo sapiens
MFGWGDFHSNIKTVKLNLLITGKIVDHGNGTFSVYFRHNSTGQGNVSVSLVPPTKIVEFDLAQQTVIDAKDSKSFNCRIEYEKVDKATKNTLCNYDPSKTCYQEQTQSHVSWLCSKPFKVICIYISFYSTDYKLVQKVCPDYNYHSDTPYFPSG

SEQ ID NO: 2833 - protein, 176 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVD

SEQ ID NO: 2834 - protein, 844 aa, Homo sapiens; identical to SEQ ID NO: 2289

SEQ ID NO: 2835 - protein, 684 aa, Homo sapiens
  MOD_RES (1)..(1): Any amino acid
XPRSSTHVPLVLPLLVLLLLAPARQAAAQRCPQACICDNSRRHVACRYQNLTEVPDAIPELTQRLDLQGNLLKVIPAAAFQGVPHLTHLDLRHCEVELVAEGAFRGLGRLLLLNLASNHLRELPQEALDGLGSLRRLELEGNALEELRPGTFGALGALATLNLAHNALVYLPAMAFQGLLRVRWLRLSHNALSVLAPEALAGLPALRRLSLHHNELQALPGPVLSQARGLARLELGHNPLTYAGEEDGLALPGLRELLLDGGALQALGPRAFAHCPRLHTLDLRGNQLDTLPPLQGPGQLRRLRLQGNPLWCGCQARPLLEWLARARVRSDGACQGPRRLRGEALDALRPWDLRCPGDAAQEEEELEERAVAGPRAPPRGPPRGPGEERAVAPCPRACVCVPESRHSSCEGCGLQAVPRGFPSDTQLLDLRRNHFPSVPRAAFPGLGHLVSLHLQHCGIAELEAGALAGLGRLIYLYLSDNQLAGLSAAALEGAPRLGYLYLERNRFLQVPGAALRALPSLFSLHLQDNAVDRLAPGDLGRTRALRWVYLSGNRITEVSLGALGPARELEKLHLDRNQLREVPTGALEGLPALLELQLSGNPLRALRDGAFQPVGRSLQHLFLNSSGLEQICPGAFSGLGPGLQSLHLQKNQLRALPALPSARRTPIKGRQCGADKVGKEKGRL

SEQ ID NO: 2836 - protein, 752 aa, Homo sapiens
MARHLLLPLVMLVISPIPGAFQDSALSPTQEEPEDLDCGRPEPSARIVGGSNAQPGTWPWQVSLHHGGGHICGGSLIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDPQEPREENCTIALPECGKAPRPGAWPWEAQVMVPGSRPCHGALVSESWVLAPASCFLDPNSSDSPPRDLDAWRVLLPSRPRAERVARLVQHENASWDNASDLALLQLRTPVNLSAASRPVCLPHPEHYFLPGSRCRLARWGRGEPALGPGALLEAELLGGWWCHCLYGRQGAAVPLPGDPPHALCPAYQEKEEVGSCWNDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQMTSAPPLLCQMTEGSWILVGMAVQGSRELFAAIGPEEAWISQTVGEANFLPPSGSPHWPTGGSNLCPPELAKASGSPHAVYFLLLLTLLIQS

SEQ ID NO: 2837 - protein, 150 aa, Homo sapiens; identical to SEQ ID NO: 2126

SEQ ID NO: 2838 - protein, 386 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQNSETSPGMFNFDTFWKNFKSKLGFINWDAINKDQRSSRIP

SEQ ID NO: 2839 - protein, 664 aa, Homo sapiens; identical to SEQ ID NO: 1972

SEQ ID NO: 2840 - protein, 139 aa, Homo sapiens; identical to SEQ ID NO: 2817

SEQ ID NO: 2841 - protein, 94 aa, Homo sapiens; identical to SEQ ID NO: 2132

SEQ ID NO: 2842 - protein, 232 aa, Homo sapiens
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSP

SEQ ID NO: 2843 - protein, 876 aa, Homo sapiens; identical to SEQ ID NO: 1912

SEQ ID NO: 2844 - protein, 54 aa, Homo sapiens
MCRETAGYGWLLASTELLSLLEPLSPQLLKEHISCTSQVAAGAKVTPDSAVWAP

SEQ ID NO: 2845 - protein, 751 aa, Homo sapiens; identical to SEQ ID NO: 1935

SEQ ID NO: 2846 - protein, 209 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVY

SEQ ID NO: 2847 - protein, 104 aa, Homo sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGE

SEQ ID NO: 2848 - protein, 876 aa, Homo sapiens; identical to SEQ ID NO: 1912

SEQ ID NO: 2849 - protein, 350 aa, Homo sapiens
MEAFALGPARRGRRRTRAAGSLLSRAAILLFISAFLVRVPSSVGHLVRLPRAFRLTKDSVKIVGSTSFPVKAYVMLHQKSPHVLCVTQQLRNAELIDPSFQWYGPKGKVVSENRTAQITSTGSLVFQNFEESMSGIYTCFLEYKPTVEEIVKRLQLKYAIYAYREPHYYYQFTARYHAAPCNSIYNISFEKKLLQILSKLLLDLSCEISLLKSECHRVKMQRAGLQNELFFAFSVSSLDTEKGPKRCTDHNCEPYKRLFKAKNLIERFFNQQVEILGRRAEQLPQIYYIEGTLQMVWINRCFPGYGMNVQQHPKCPECCVICSPGSYNPRDGIHCLQCNSSLVYGAKTCL

SEQ ID NO: 2850 - protein, 463 aa, Homo sapiens
  MOD_RES (1)..(1): Any amino acid
XLALVLCTVDSRPPAQLALSHAGRLLASSTAASVPNTLRLELRGPQPRDEGFYSCSARSPLGQANTSLELRLEGVRVILAPEAAVPEGAPITVTCADPAAHAPTLYTWYHNGRWLQEGPAASLSFLVATRAHAGAYSCQAQDAQGTRSSRPAALQVLYAPQDAVLSSFRDSRARSMAVIQCTVDSEPPAELALSHDGKVLATSSGVHSLASGTGHVQVARNALRLQVQDVPAGDDTYVCTAQNLLGSISTIGRLQVEGARVVAEPGLDVPEGAALNLSCRLLGGPGPVGNSTFAWFWNDRRLHAEPVPTLAFTHVARAQAGMYHCLAELPTGAAASAPVMLRVLYPPKTPTMMVFVEPEGGLRGILDCRVDSEPLASLTLHLGSRLVASSQPQGAPAEPHIHVLASPNALRVDIEALRPSDQGEYICSASNVLGSASTSTYFGVRGEGRGLHLPGHSAQKPSS

SEQ ID NO: 2851 - protein, 465 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 2852 - protein, 899 aa, Homo sapiens; identical to SEQ ID NO: 2512

SEQ ID NO: 2853 - protein, 126 aa, Homo sapiens
MWYVSTRGVAPRVNFEGALFSGYAPDGGLFMPEELPQLDRGTLCQWSTLSYPGLVKELCALFIGSELLPKDELNDLIDRAFSRFRHREVVHLSRLRNGLNVLELWHGVTYAFKDLSLSCTTQFLQY

SEQ ID NO: 2854 - protein, 48 aa, Homo sapiens
MPPFLITLFLFHSCCLRANGHLREGMTLLKTEFALHLYQSVAACRNET

SEQ ID NO: 2855 - protein, 129 aa, Homo sapiens; identical to SEQ ID NO: 2490

SEQ ID NO: 2856 - protein, 153 aa, Homo sapiens
MTIHILILLLLLAFSAQGDLDTAARRGQHQVPQHRGHVCYLGVCRTHRLAEIIYWIRCLHQGALGEGQPRAPGPLQLWAPPVARGGSPARFPGFRPAARGLAQCPARWVTSGTARPLLGFSLPICMLELLLHISSPLTPAPETVFPSPSPGCD

SEQ ID NO: 2857 - protein, 149 aa, Homo sapiens
MGWLTRIVCLFWGVLLTARANYQNGKNNVPRLKLSYKEMLESNNVITFNGLANSSSYHTFLLDEERSRLYVGAKDHIFSFDLVNIKDFQKIVWPVSYTRRDECKWAGKDILKECANFIKVLKAYNQTHLYACGTGAFHPICTYIEIGHH

SEQ ID NO: 2858 - protein, 180 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHV

SEQ ID NO: 2859 - protein, 209 aa, Homo sapiens; identical to SEQ ID NO: 2846

SEQ ID NO: 2860 - protein, 209 aa, Homo sapiens; identical to SEQ ID NO: 2846

SEQ ID NO: 2861 - protein, 876 aa, Homo sapiens; identical to SEQ ID NO: 1912

SEQ ID NO: 2862 - protein, 700 aa, Homo sapiens
MLAPFLLLLTHSRSPLSFRPCSHVPGALIAQKPMGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 2863 - protein, 397 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 2864 - protein, 203 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTT

SEQ ID NO: 2865 - protein, 430 aa, Homo sapiens
MRKLMKQVQEQCPNITRIYSIGKSYQGLKLYVMEMSDKPGEHELGEPEVRYVAGMHGNEALGRELLLLLMQFLCHEFLRGNPRVTRLLSEMRIHLLPSMNPDGYEIAYHRGSELVGWAEGRWNNQSIDLNHNFADLNTPLWEAQDDGKVPHIVPNHHLPLPTYYTLPNATVAPETRAVIKWMKRIPFVLSANLHGGELVVSYPFDMTRTPWAARELTPTPDDAVFRWLSTVYAGSNLAMQDTSRRPCHSQDFSVHGNIINGADWHTVPGSMNDFSYLHTNCFEVTVELSCDKFPHENELPQEWENNKDALLTYLEQVRMGIAGVVRDKDTELGIADAVIAVDGINHDVTTAWGGDYWRLLTPGDYMVTASAEGYHSVTRNCRVTFEEGPFPCNFVLTKTPKQRLRELLAAGAKVPPDLRRRLERLRGQKD

SEQ ID NO: 2866 - protein, 559 aa, Homo sapiens; identical to SEQ ID NO: 1951

SEQ ID NO: 2867 - protein, 2732 aa, Homo sapiens
MEQTDCKPYQPLPKVKHEMDLAYTSSSDESEDGRKPRQSYNSRETLHEYNQELRMNYNSQSRKRKEVEKSTQEMEFCETSHTLCSGYQTDMHSVSRHGYQLEMGSDVDTETEGAASPDHALRMWIRGMKSEHSSCLSSRANSALSLTDTDHERKSDGENGFKFSPVCCDMEAQAGSTQDVQSSPHNQFTFRPLPPPPPPPHACTCARKPPPAADSLQRRSMTTRSQPSPAAPAPPTSTQDSVHLHNSWVLNSNIPLETRHFLFKHGSGSSAIFSAASQNYPLTSNTVYSPPPRPLPRSTFSRPAFTFNKPYRCCNWKCTALSATAITVTLALLLAYVIAVHLFGLTWQLQPVEGELYANGVSKGNRGTESMDTTYSPIGGKVSDKSEKKVFQKGRAIDTGEVDIGAQVMQTIPPGLFWRFQITIHHPIYLKFNISLAKDSLLGIYGRRNIPPTHTQFDFVKLMDGKQLVKQDSKGSDDTQHSPRNLILTSLQETGFIEYMDQGPWYLAFYNDGKKMEQVFVLTTAIEIMDDCSTNCNGNGECISGHCHCFPGFLGPDCARDSCPVLCGGNGEYEKGHCVCRHGWKGPECDVPEEQCIDPTCFGHGTCIMGVCICVPGYKGEICEEEDCLDPMCSNHGICVKGECHCSTGWGGVNCETPLPVCQEQCSGHGTFLLDAGVCSCDPKWTGSDCSTELCTMECGSHGVCSRGICQCEEGWVGPTCEERSCHSHCTEHGQCKDGKCECSPGWEGDHCTIAHYLDAVRDGCPGLCFGNGRCTLDQNGWHCVCQVGWSGTGCNVVMEMLCGDNLDNDGDGLTDCVDPDCCQQSNCYISPLCQGSPDPLDLIQQSQTLFSQHTSRLFYDRIKFLIGKDSTHVIPPEVSFDSRRACVIRGQVVAIDGTPLVGVNVSFLHHSDYGFTISRQDGSFDLVAIGGISVILIFDRSPFLPEKRTLWLPWNQFIVVEKVTMQRVVSDPPSCDISNFISPNPIVLPSPLTSFGGSCPERGTIVPELQVVQEEIPIPSSFVRLSYLSSRTPGYKTLLRILLTHSTIPVGMIKVHLTVAVEGRLTQKWFPAAINLVYTFAWNKTDIYGQKVWGLAEALVSVGYEYETCPDFILWEQRTVVLQGFEMDASNLGGWSLNKHHILNPQSGIIHKGNGENMFISQQPPVISTIMGNGHQRSVACTNCNGPAHNNKLFAPVALASGPDGSVYVGDFNFVRRIFPSGNSVSILELRNRDTRHSTSPAHKYYLAMDPVSESLYLSDTNTRKVYKLKSLVETKDLSKNFEVVAGTGDQCLPFDQSHCGDGGRASEASLNSPRGITVDRHGFIYFVDGTMIRKIDENAVITTVIGSNGLTSTQPLSCDSGMDITQVRLEWPTDLAVNPMDNSLYVLDNNIVLQISENRRVRIIAGRPIHCQVPGIDHFLVSKVAIHSTLESARAISVSHSGLLFIAETDERKVNRIQQVTTNGEIYIIAGAPTDCDCKIDPNCDCFSGDGGYAKDAKMKAPSSLAVSPDGTLYVADLGNVRIRTISRNQAHLNDMNIYEIASPADQELYQFTVNGTHLHTLNLITRDYVYNFTYNSEGDLGAITSSNGNSVHIRRDAGGMPLWLVVPGGQVYWLTISSNGVLKRVSAQGYNLALMTYPGNTGLLATKSNENGWTTVYEYDPEGHLTNATFPTGEVSSFHSDLEKLTKVELDTSNRENVLMSTNLTATSTIYILKQENTQSTYRVNPDGSLRVTFASGMEIGLSSEPHILAGAVNPTLGKCNISLPGEHNANLIEWRQRKEQNKGNVSAFERRLRAHNRNLLSIDFDHITRTGKIYDDHRKFTLRILYDQTGRPILWSPVSRYNEVNITYSPSGLVTFIQRGTWNEKMEYDQSGKIISRTWADGKIWSYTYLEKSVMLLLHSQRRYIFEYDQPDCLLSVTMPSMVRHSLQTMLSVGYYRNIYTPPDSSTSFIQDYSRDGRLLQTLHLGTGRRVLYKYTKQARLSEVLYDTTQVTLTYEESSGVIKTIHLMHDGFICTIRYRQTGPLIGRQIFRFSEEGLVNARFDYSYNNFRVTSMQAVINETPLPIDLYRYVDVSGRTEQFGKFSVINYDLNQVITTTVMKHTKIFSANGQVIEVQYEILKAIAYWMTIQYDNVGRMVICDIRVGVDANITRYFYEYDADGQLQTVSVNDKTQWRYSYDLNGNINLLSHGKSARLTPLRYDLRDRITRLGEIQYKMDEDGFLRQRGNDIFEYNSNGLLQKAYNKASGWTVQYYYDGLGRRVASKSSLGQHLQFFYADLTNPIRVTHLYNHTSSEITSLYYDLQGHLIAMELSSGEEYYVACDNTGTPLAVFSSRGQVIKEILYTPYGDIYHDTYPDFQVIIGFHGGLYDFLTKLVHLGQRDYDVVAGRWTTPNHHIWKQLNLLPKPFNLYSFENNYPVGKIQDVAKYTTDIRSWLELFGFQLHNVLPGFPKPELENLELTYELLRLQTKTQEWDPGKTILGIQCELQKQLRNFISLDQLPMTPRYNDGRCLEGGKQPRFAAVPSVFGKGIKFAIKDGIVTADIIGVANEDSRRLAAILNNAHYLENLHFTIEGRDTHYFIKLGSLEEDLVLIGNTGGRRILENGVNVTVSQMTSVLNGRTRRFADIQLQHGALCFNIRYGTTVEEEKNHVLEIARQRAVAQAWTKEQRRLQEGEEGIRAWTEGEKQQLLSTGRVQGYDGYFVLSVEQYLELSDSANNIHFMRQSEIGRR

SEQ ID NO: 2868 - protein, 87 aa, Homo sapiens
MKVLLLTGLGALFFAYYWDDNFDPASLQGARVLLTGANAGVGEELAYHYARLGSHLVLTAHTEALLQKARWLTLVVSTLGGRGKWIT

SEQ ID NO: 2869 - protein, 410 aa, Homo sapiens
MRACISLVLAVLCGLAWAGKIESCASRCNEKFNRDAACQCDRRCLWHGNCCEDYEHLCTEDHKESEPLPQLEEETEEALASNLYSAPTSCQGRCYEAFDKHHQCHCNARCQEFGNCCKDFESLCSDHEVSHSSDAITKEEIQSISEKIYRADTNKAQKEDIVLNSQNCISPSETRNQVDRCPKPLFTYVNEKLFSKPTYAAFINLLNNYQRATGHGEHFSAQELAEQDAFLREIMKTAVMKELYSFLHHQNRYGSEQEFVDDLKNMWFGLYSRGNEEGDSSGFEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 2870 - protein, 116 aa, Homo sapiens; identical to SEQ ID NO: 2491

SEQ ID NO: 2871 - protein, 399 aa, Homo sapiens [sequence omitted]

SEQ ID NO: 2872 - protein, 169 aa, Homo sapiens
MLSSVVFWGLIALIGTSRGSYPFSHSMKPHLHPRLYHGCYGDIMTMKTSGATCDANSVMNCGIRGSEMFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVA

SEQ ID NO: 2873 - protein, 99 aa, Homo sapiens
MERISAFFSSIWDTILTKHQEGIYNTICLGVLLGLPLLVIITLLFICCHCCWSPPGKRGQQPEKNKKKKKKKKKKDEEDLWISAQPKLLQMEKRPSLPV

SEQ ID NO: 2874 - protein, 155 aa, Homo sapiens
MTSLKCGENLYMSSASSSWSQAIQSWFDEYNDFDFGVGPKTPNAVVGHYTQVVWYSSYLVGCGNAYCPNQKVLKYYYVCQYCPAGNWANRLYVPYEQGAPCASCPDNCDDGLCTNGCKYEDLYSNCKSLKLTLTCKHQLVRDSCKASCNCSNSIY

SEQ ID NO: 2875 - protein, 961 aa, Homo sapiens; identical to SEQ ID NO: 2513

SEQ ID NO: 2876 - protein, 147 aa, Homo sapiens
MAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSA

SEQ ID NO: 2877 - protein, 315 aa, Homo sapiens
MKVLLLTGLGALFFAYYWDDNFDPASLQGARVLLTGANAGVGEELAYHYARLGSHLVLTAHTEALLQKVVGNCRKLGAPKVFYIAADMASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRSSTSRPRQPEHRGVPLQSQTAMFLPPTVPGARTLTETPLRGWPQPKMKSSRQKSKTEKNDGHLEPVTAWEVQVPRVRRLCRGLARPHLFGHD

SEQ ID NO: 2878 - protein, 94 aa, Homo sapiens; identical to SEQ ID NO: 2132

SEQ ID NO: 2879 - protein, 260 aa, Homo sapiens
MEKFNTISVSKCNKETVAMKEKCKFGMTSTIPSGHVWRNTWNPVSCSLATVKMKECLRGKLIYLMGDSTIRQWMEYFKASINTLKSVDLHESGKLQHQLAVDLDRNINIQWQKYCYPLIGSMTYSVKEMEYLTRAIDRTGGEKNTVIVISLGQHFRPFPIDVFIRRALNVHKAIQHLLLRSPDTMVIIKTENIREMYNDAERFSDFHGYIQYLIIKDIFQDLSVSIIDAWDITIAYGTNNVHPPQHVVGNQINILLNYIC

SEQ ID NO: 2880 - protein, 547 aa, Homo sapiens
MSSNTMLQKTLLILISFSVVTWMIFIISQNFTKLWSALNLSISVHYWNNSAKSLFPKTSLIPLKPLTETELRIKEIIEKLDQQIPPRPFTHVNTTTSATHSTATILNPRDTYCRGDQLDILLEVRDHLGQRKQYGGDFLRARMSSPALTAGASGKVMDFNNGTYLVSFTLFWEGQVSLSLLLIHPSEGASALWRARNQGYDKIIFKGKFVNGTSHVFTECGLTLNSNAELCEYLDDRDQEAFYCMKPQHMPCEALTYMTTRNREVSYLTDKENSLFHRSKVGVEMMKDRKHIDVTNCNKREKIEETCQVGMKPPVPGGYTLQGKWITTFCNQVQLDTIKINGCLKGKLIYLLGDSTLRQWIYYFPKVVKTLKFFDLHETGIFKKHLLLDAERHTQIQWKKHSYPFVTFQLYSLIDHDYIPREIDRLSGDKNTAIVITFGQHFRPFPIDIFIRRAIGVQKAIERLFLRSPATKVIIKTENIREMHIETERFGDFHGYIHYLIMKDIFKDLNVGIIDAWDMTIAYGTDTIHPPDHVIGNQINMFLNYIC

SEQ ID NO: 2881 - protein, 132 aa, Homo sapiens
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMH

SEQ ID NO: 2882 - protein, 286 aa, Homo sapiens
MGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 2883 - protein, 19 aa, Homo sapiens
MGWLTRIVCLFWGVLLTAR

SEQ ID NO: 2884 - protein, 398 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQGFRGQGVSSNMRNSETSPGMFNFDTFWKNFKSKLGFINWDAINKDQRSSRIP

SEQ ID NO: 2885 - protein, 26 aa, Homo sapiens
MAPKKLSCLRSLLLPLSLTLLLPQAD

SEQ ID NO: 2886 - protein, 231 aa, Homo sapiens
MAQLFLPLLAALVLAQAPAALADVLEGDSSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLF

SEQ ID NO: 2887 - protein, 199 aa, Homo sapiens
MDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVTPTHGVDSLTST

SEQ ID NO: 2888 - protein, 202 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHT

SEQ ID NO: 2889 - protein, 961 aa, Homo sapiens; identical to SEQ ID NO: 2513

SEQ ID NO: 2890 - protein, 116 aa, Homo sapiens; identical to SEQ ID NO: 2491

SEQ ID NO: 2891 - protein, 777 aa, Homo sapiens
MAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 2892 - protein, 277 aa, Homo sapiens
MLHPETSPGRGHLLAVLLALLGTTWAEVWPPQLQEQAPMAGALNRKESFLLLSLHNRLRSWVQPPAADMRRLLVWATSSQLGCGRHLCSAGQTAIEAFVCAYSPGGNWEVNGKTIIPYKKGAWCSLCTASVSGCFKAWDHAGGLCEVPRNPCRMSCQNHGRLNISTCHCHCPPGYTGRYCQGHLPNSNMPHSAMGTKPKTPGVPAIGSLVRCSLQCVHGRFREEECSCVCDIGYGGAQCASESCPRAPKEPAPLKTPLQWGISSQEPAVCLSFQLIQ

SEQ ID NO: 2893 - protein, 151 aa, Homo sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRV

SEQ ID NO: 2894 - protein, 129 aa, Homo sapiens; identical to SEQ ID NO: 2490

SEQ ID NO: 2895 - protein, 129 aa, Homo sapiens; identical to SEQ ID NO: 2490

SEQ ID NO: 2896 - protein, 296 aa, Homo sapiens
MEALLLGAGLLLGAYVLVYYNLVKAPPCGGMGNLRGRTAVVTGISSCGRTREAFNLLLRVNHIGPFLLTHLLLPCLKACAPSRVVVVASAAHCRGRLDFKRLDRPVVGWRQELRAYADTKLANVLFARELANQLEATGVTCYAAHPGPVNSELFLRHVPGWLRPLLRPLAWLVLRAPRGGAQTPLYCALQEGIEPLSGRYFANCHVEEVPPAARDDRAAHRLWEASKRLAGLGPGEDAEPDEDPQSEDSEAPSSLSTPHPEEPTVSQPYPSPQSSPDLSKMTHRIQAKVEPEIQLS

SEQ ID NO: 2897 - protein, 188 aa, Homo sapiens; identical to SEQ ID NO: 2489

SEQ ID NO: 2898 - protein, 325 aa, Homo sapiens; identical to SEQ ID NO: 1911

SEQ ID NO: 2899 - protein, 876 aa, Homo sapiens; identical to SEQ ID NO: 1912

SEQ ID NO: 2900 - protein, 493 aa, Homo sapiens
MALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGMYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 2901 - protein, 595 aa, Homo sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDEHIPAPLDQGSEQPLFQPLDHQATSLPSRDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 2902 - protein, 69 aa, Homo sapiens
MKNQDKKNGAAKQSNPKSSPGQPEAGSFDSLDLEKVSLGRALAGRSELGISCLEQGTWRMFLRGMMCWS

SEQ ID NO: 2903 - protein, 160 aa, Homo sapiens
MARDYDHLFKLLIIGDSGVGKSSLLLRFADNTFSGSYITTIGVDFKIRTVEINGEKVKLQIWDTAGQERFRTITSTAETALRSLPQPEAHGGSSGDSLSFVPLFKEFSPCFCIGRCHRHFLPRPPRVPRRCWTSPPFPTGAPSSPAKAPGPGEDAARRAD

SEQ ID NO: 2904 - protein, 119 aa, Homo sapiens; identical to SEQ ID NO: 2228

SEQ ID NO: 2905 - protein, 837 aa, Homo sapiens
MFKCWSVVLVLGFIFLESEGRPTKEGGYGLKSYQPLMRLRHKEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTRLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 2906 - protein, 215 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAK

SEQ ID NO: 2907 - protein, 1278 aa, Homo sapiens
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRGYNQILIVPMGATSILIDEAAASRNFLAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHAYPVRCLLPSAHGSCADWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPRHQLQPDGSLVISRVAVEDGGFYTCVAFNGQDRDQRWVQLRVLGELTISGLPPTVTVPEGDTARLLCVVAGESVNIRWSRNGLPVQADGHRVHQSPDGTLLIYNLRARDEGSYTCSAYQGSQAVSRSTEVKVVSPAPTAQPRDPGRDCVDQPELANCDLILQAQLCGNEYYSSFCCASCSRFQPHAQPIWQ

SEQ ID NO: 2908 - protein, 181 aa, Homo sapiens
  MOD_RES (1)..(1): Any amino acid
XKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQDNLCSPSDILQLNLSVKRTVETLLSLGAHSEESSFVCLSLQLLGFVAFYCTVMLTLCVLYYWLFPAR

SEQ ID NO: 2909 - protein, 267 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGY

SEQ ID NO: 2910 - protein, 114 aa, Homo sapiens
MAPKKLSCLRSLLLPLSLTLLLPQADTRSFVVDRGHDRFLLDGAPFRYVSGSLHYFRVPRVLWADRLLKMRWSGLNAIQFYVPWNYHEPQPGVYNFNGSRDLIAFLNEAALANL

SEQ ID NO: 2911 - protein, 168 aa, Homo sapiens
APRMEMFQGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 2912 - protein, 400 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVTNALHSILGEGNVPDPKHHYGVSGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEASPMDWTIALKSPTHYRQTGMRTGWEMLATAALK

SEQ ID NO: 2913 - protein, 205 aa, Homo sapiens; identical to SEQ ID NO: 2215

SEQ ID NO: 2914 - protein, 58 aa, Homo sapiens
MDLLQFLAFLFVLLLSGMGATGTLRTSLDPSLEIYKKMFEVKRREQLLALKNLAQLND

SEQ ID NO: 2915 - protein, 149 aa, Homo sapiens
MKVIAILTLLLFCSPTHSSFWQFQRRVKHITGRSAFFSYYGYGCYCGLGDKGIPVDDTDRHSPSSPSPYEKLKEFSCQPVLNSYQFHIVNGAVVCGCTLGPGASCHCRLKACECDKQSVHCFKESLPTYEKNFKQFSSQPRCGRHKPWC

SEQ ID NO: 2916 - protein, 78 aa, Homo sapiens; identical to SEQ ID NO: 2320

SEQ ID NO: 2917 - protein, 486 aa, Homo sapiens
MISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 2918 - protein, 80 aa, Homo sapiens
  MOD_RES (1)..(1): Any amino acid
XNGPVLWFKGTGPNRKLIYNFKQEQNPRPPKNRPAGRAGSRAHHDAHTCLSALPERNSTNYFVQPCCCLRLLGLTGLLSK

SEQ ID NO: 2919 - protein, 446 aa, Homo sapiens
MLHPETSPGRGHLLAVLLALLGTTWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQTAIEAFVCAYSPRGNWEVNGKTIIPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNDQRCKTRNRYICQFAQEHISRWGPGS

SEQ ID NO: 2920 - protein, 143 aa, Homo sapiens
MQAACWYVLFLLQPTVYLVTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITGKIVD

SEQ ID NO: 2921 - protein, 260 aa, Homo sapiens
MQGEPFACLTHQEPLPKMFKLLSRAYADVHPMMMDRSENRCGGNFLKRGSIINGADWYSFTGGMSDFNYLHTNCFEITVELGCVKFPPEEALYILWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 2922 - protein, 293 aa, Homo sapiens
MSSGGGSRGLLAWLLLLQPWPGQNWAGMAAPRLPSPLLSEEGGENPEASPAPGPEAGPPLNLFTSFPGDSLLCGRTPLRIVGGVDAEEGRWPWQVSVRTKGRHICGGTLVTATWVLTAGHCISSRFHYSVKMGDRSVYNENTSVVVSVQRAFVHPKFSTVTTIRNDLALLQLQHPVNFTSNIQPICIPQENFQVEGRTRCWVTGWGKTPEREKLASEILQDVDQYIMCYEECNKIIQKALSSTKDVIIKGMVCGYKEQGKDSCQGDSGGRLACEYNDTWVQVGIVSWGIGCGR

SEQ ID NO: 2923 - protein, 289 aa, Homo sapiens
MFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDRGEQGDPGLPGVCRCGSIVLKSAFSVGITTSYPEERLPIIFNKVLFNEGEHYNPATGKFICAFPGIYYFSYDITLANKHLAIGLVHNGQYRIKTFDANTGNHDVASGSTVIYLQPEDEVWLEIFFTDQNGLFSDPGWADSLFSGFLLYVDTDYLDSISEDDEL

SEQ ID NO: 2924 - protein, 913 aa, Homo sapiens; identical to SEQ ID NO: 2128

SEQ ID NO: 2925 - protein, 362 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 2926 - protein, 449 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGSSTGSSSGNHGGSGGGNGHKPGCEKPGNEARGSGESGIQGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 2927 - protein, 244 aa, Homo sapiens
MWGAPLPRRPVWDVRSASAGPQPCLGGKMKLNLVQIFFMLLMLLLGLGMGLGLGLHMATAVLEESDQPLNEFWSSDSQDKAEATEEGDGTQTTETLVLSNKEVVQPGWPEDPILGEDEVGGNKMLRASALFQSNKDYLRLDQTDRECNDMMAHKMKEPSQSCIAQYAFIHEDLNTVKAVCNSPVIACELKGGKCHKSSRPFDLTLCELSQPDQVTPNCNYLTSVIKKHIIITCNDMKRQLPTGQ

SEQ ID NO: 2928 - protein, 575 aa, Homo sapiens; identical to SEQ ID NO: 1950

SEQ ID NO: 2929 - protein, 129 aa, Homo sapiens; identical to SEQ ID NO: 2490

SEQ ID NO: 2930 - protein, 188 aa, Homo sapiens; identical to SEQ ID NO: 2489

SEQ ID NO: 2931 - protein, 891 aa, Homo sapiens; identical to SEQ ID NO: 2482

SEQ ID NO: 2932 - protein, 913 aa, Homo sapiens; identical to SEQ ID NO: 2128

SEQ ID NO: 2933 - protein, 150 aa, Homo sapiens; identical to SEQ ID NO: 2126

SEQ ID NO: 2934 - protein, 63 aa, Homo sapiens
MGPEALSSLLLLLLVASGDADMKGHFDPAKCRYALGMQDRTIPDSDISASSSWSDSTAARHSR

SEQ ID NO: 2935 - protein, 403 aa, Homo sapiens
MQGTPGGGTRPGPSPVDRRTLLVFSFILAAALGQMNFTGDQVLRVLAKDEKQLSLLGDLEGLKPQKVDFWRGPARPSLPVDMRVPFSELKDIKAYLESHGLAYSIMIKDIQVLLDEERQAMAKSRRLERSTNSFSYSSYHTLEEIYSWIDNFVMEHSDIVSKIQIGNSFENQSILVLKFSTGGSRHPAIWIDTGIHSREWITHATGIWTANKIVSDYGKDRVLTDILNAMDIFIELVTNPDGFAFTHSMNRLWRKNKSIRPGIFCIGVDLNRNWKSGFGGNGSNSNPCSETYHGPSPQSEPEVAAIVNFITAHGNFKALISIHSYSQMLMYPYGRLLEPVSNQRELMWPVGSPSTGPMTVASSTPSALSSGTLGSMASCCRPHRSSPRPRRRGWRFGPSWSTP

SEQ ID NO: 2936 - protein, 513 aa, Homo sapiens
MAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 2937 - protein, 265 aa, Homo sapiens
MAPWSHPSAQLQPVGGDAVSPALMVLLCLGLSLGPRTHVQAGNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGEEATVFSSTIQGSQTGCGELYRQGSPC

SEQ ID NO: 2938 - protein, 264 aa, Homo sapiens
MEKPILKNLNEMLCPIIASEVKALNANLSTLEVLTKIDNYTLLDYSLISSPEITENYLDLNLKGVFYPLENLTDPPFSPVPFVLPERSNSMLYIGIAEYFFKSASFAHFTAGVFNVTLSTEEISNHFVQNSQGLGNVLSRVASTSVGLVILGQRLVCSLSLNRFRLALPESNRSNIEVLRFENILSSILHFGVLPLANAKLQQGFPLSNPHKFLFVNSDIEVLEGFLLISTDLKYETSSKQQPSFHVWEGLNLISRQWRGKSAP

SEQ ID NO: 2939 - protein, 38 aa, Homo sapiens
MNKILSSTVCFGLLTLLSVLSFLQSVHGRPYLTQGNEI

SEQ ID NO: 2940 - protein, 188 aa, Homo sapiens; identical to SEQ ID NO: 2489

SEQ ID NO: 2941 - protein, 199 aa, Homo sapiens; identical to SEQ ID NO: 2193

SEQ ID NO: 2942 - protein, 9 aa, Homo sapiens
MAPKKLSCL

SEQ ID NO: 2943 - protein, 276 aa, Homo sapiens
MAPSPLQRLHCGPSPSPRPTEVPRGTVSVSCRYLKNSLHVFVSGGAIGTSSPALLECQEGVGPARPSLLVPPPPRPRRLDLARTLPAERTDSQSLYIVYIALPGRTPRPALAFAFLMPACCNRPSPRPSPAHLTASSVLRRQRHVLAASAASPCQWSGLRVAHSLRQVVSLCPRCTGSCPFSGACASSLPSPLSCPHSHSGSWGTWSQGRPCSSTEVAGLALWPTDFLSCLLDASELQTQGSHGFSFTPTGFSSNRKVGVGSCRDGAGRGAMGGLF

SEQ ID NO: 2944 - protein, 225 aa, Homo sapiens; identical to SEQ ID NO: 2797
  MOD_RES (1)..(1): Any amino acid

SEQ ID NO: 2945 - protein, 177 aa, Homo sapiens
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPPCHLLRICGWC

SEQ ID NO: 2946 - protein, 303 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGEPSVPPRCIFPSTPVT

SEQ ID NO: 2947 - protein, 493 aa, Homo sapiens; identical to SEQ ID NO: 2813

SEQ ID NO: 2948 - protein, 268 aa, Homo sapiens
MKQILHPALETTDPCSTGFVFPAMTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYVCQYCPAGNWANRLYVPYEQGAPCASCPDNCDDGLCTNGCKYEDLYSNCKSLKLTLTCKHQLVRDSCKASCNCSNSIY

SEQ ID NO: 2949 - protein, 123 aa, Homo sapiens
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDT

SEQ ID NO: 2950 - protein, 241 aa, Homo sapiens
MGAVMGTFSSLQTKQRRPSKDKIEDELEMTMVCHRPEGLEQLEAQTNFTKRELQVLYRGFKNECPSGVVNEDTFKQIYAQFFPHGALPCLEGSPCVEFLPPSPALLFCLVDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 2951 - protein, 209 aa, Homo sapiens; identical to SEQ ID NO: 2846

SEQ ID NO: 2952 - protein, 103 aa, Homo sapiens
MRQRLLPSVTSLLLVALLFPGSSQARHVNHSATEALGELRERAPGQGTNGFQLLRHAVKRDLLPPRTPPYQVHISHQEARGPSFKICVGFLGPRWARGCSTGN

SEQ ID NO: 2953 - protein, 141 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFL

SEQ ID NO: 2954 - protein, 213 aa, Homo sapiens
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 2955 - protein, 899 aa, Homo sapiens; identical to SEQ ID NO: 2512

SEQ ID NO: 2956 - protein, 63 aa, Homo sapiens; identical to SEQ ID NO: 2934

SEQ ID NO: 2957 - protein, 162 aa, Homo sapiens
DEDRYTTCWPKTWLAKDCPALRIISVEYDTSLSDWRARCPMERKSIAFRSNELLRKLRAAGVGDRPVVWISHSMGGLLVKKMLLEASTKPEMSTVINNTRGIIFYSVPHHGSRLAEYSVNIRYLLFPSLEVKELSKGNTFCHKGNWGYINISYTEKKKKFLP

SEQ ID NO: 2958 - protein, 360 aa, Homo sapiens; identical to SEQ ID NO: 1850

SEQ ID NO: 2959 - protein, 225 aa, Homo sapiens; identical to SEQ ID NO: 2797
  MOD_RES (1)..(1): Any amino acid

SEQ ID NO: 2960 - protein, 63 aa, Homo sapiens; identical to SEQ ID NO: 1907

SEQ ID NO: 2961 - protein, 1744 aa, Homo sapiens; identical to SEQ ID NO: 2466

SEQ ID NO: 2962 - protein, 263 aa, Homo sapiens
MADMQNLVERLERAVGRLEAVSHTSDMHRGYADSPSKGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSCPPPPPPCPPPPPVSTISCSYESASRSSLFAQINQG

SEQ ID NO: 2963 - protein, 166 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRF

SEQ ID NO: 2964 - protein, 782 aa, Homo sapiens
SILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMETYEDQHSSEEEEEEEEEEESEDGEEEDDITSAESESSEEEEGEQGDPQNATRQQQLEWDDSTLSY

SEQ ID NO: 2965 - protein, 176 aa, Homo sapiens
MARRHCFSYWLLVCWLVVTVAEALSTFYLQQHINLHMDKKRYLRLLEIHKIMRTLPTARSLHSPLHLPRGVRSQGPSPSQRHPGVPSIFFHEGPESILGFQTDLSSLQGVTTVFHSSHFIGHTVTLLIGISPEEDSREEAHLRKAEREEKPKHTEAKKSLSFRKKQQKDFCFIFRN

SEQ ID NO: 2966 - protein, 393 aa, Homo sapiens; identical to SEQ ID NO: 2122

SEQ ID NO: 2967 - protein, 107 aa, Homo sapiens
MLPCLALLLLMELSVCTVAGDGGEEQTLSTEAETWEGAGPSIQLQLQEVKTGKASQFFGLMGKRVGGRPLIQPRRKKAYQLEHTFQGLLGKRSLFTEGREDEAQGSE

SEQ ID NO: 2968 - protein, 361 aa, Homo sapiens
MGIIQSILATSRDCYSFKKKPIPKKPTMLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNTGIVFGAILGAILGVSLLTLVGYLLCGKRKTDSFSHRRLYDDRNEPVLRLDNAPEPYDVSFGNSSYYNPTLNDSAMPESEENARDGIPMDDIPPLRTSV

SEQ ID NO: 2969 - protein, 92 aa, Homo sapiens
MRGPGHPLLLGLLLVLGPSPEQRVEIVPRDLRMKDKFLKHLTGPLYFSPKCSKHFHRLYHNTRDCTIPAYYKRCARLLTRLAVSPVCMEDKQ

SEQ ID NO: 2970 - protein, 374 aa, Homo sapiens
  MOD_RES (1)..(1): Any amino acid
XRVRRGPLPADRPRALGPARRCSRHPHPAPFRVCSEGAAHRLRRPERLPLPSRALRPRPAHTPILGPAPRACPGAPRASDSPTCAAAAATAWPRTRAVERKGCQVAAAAGVRGTGCPSRADLEKDSWNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 2971 - protein, 139 aa, Homo sapiens
MALRMLWAGQAKGILGGWGIICLVMSLLLQHPGVYSKCYFQAQAPCHYEGKYFTLGESWLRKDCFHCTCLHPVGVGCCDTSQHPIDFPAGCEVRQEAGTCQFSLVQKSDPRLPCKGGGPDPEWGSANTPVPGAPAPHSS

SEQ ID NO: 2972 - protein, 153 aa, Homo sapiens
HYCKEGYYRDMGKPITHRKACKACDCHPVGAAGKTCNQTTGQCPCKDGVTGITCNRCAKGYQQSRSPIAPCIKIPVAPPTTAASSVEEPEAARQPNTFQAEGLSLLPGAAEKEGARCWGYRRRLGHRVAQAECRGPRSWAWGRITSSFSFASN

SEQ ID NO: 2973 - protein, 70 aa, Homo sapiens
MLVLFLLGTVFLLCPYWGELHDPIKGQSMYHYSKLSCMTSCEDINFLGFTKRVELICCDHSNYCNLPEGV

SEQ ID NO: 2974 - protein, 188 aa, Homo sapiens; identical to SEQ ID NO: 2489

SEQ ID NO: 2975 - protein, 771 aa, Homo sapiens [sequence omitted]

SEQ ID NO: 2976 - protein, 337 aa, Homo sapiens
MARPMIKEARMASLLLENPYYGCRKPKDQVRSSLKNVSDLFVMGGALVLESAALLHWLEREGYGPLGMTGISMGGHMASLAVSNWPKPMPLIPCLSWSTASGVFTTGVLSKSINWRELEKQYYTQTVYEEEIIHMLEYCGTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFRQAIYDAFDRFLHKYAN

SEQ ID NO: 2977 - protein, 153 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLK

SEQ ID NO: 2978 - protein, 114 aa, Homo sapiens
MDKSLLLELPILLCCFRALSGSLSMRNDAVIEIVQCRMCHLQFPGEKCSRGRGICTATTEEACMVGRMFKRDGNPWLTFMGCLKNCADVKGIRWSVYLVNFRCCRSHDLCNEDL

SEQ ID NO: 2979 - protein, 209 aa, Homo sapiens; identical to SEQ ID NO: 2846

SEQ ID NO: 2980 - protein, 212 aa, Homo sapiens
DFGYCPRVYCENQPMLPIGVLVMVGFTVGKVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 2981 - protein, 79 aa, Homo sapiens; identical to SEQ ID NO: 2737

SEQ ID NO: 2982 - protein, 539 aa, Homo sapiens
MSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 2983 - protein, 844 aa, Homo sapiens; identical to SEQ ID NO: 2289

SEQ ID NO: 2984 - protein, 330 aa, Homo sapiens
MQLFLLLCLVLLSPQGASLHRHHPREMKKRVEDLHVGATVAPSSRRDFTFDLLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 2985 - protein, 891 aa, Homo sapiens; identical to SEQ ID NO: 2482

SEQ ID NO: 2986 - protein, 235 aa, Homo sapiens; identical to SEQ ID NO: 2268

SEQ ID NO: 2987 - protein, 461 aa, Homo sapiens [sequence omitted]

SEQ ID NO: 2988 - protein, 891 aa, Homo sapiens; identical to SEQ ID NO: 2482

SEQ ID NO: 2989 - protein, 166 aa, Homo sapiens; identical to SEQ ID NO: 2963

SEQ ID NO: 2990 - protein, 139 aa, Homo sapiens
MQAACWYVLFLLQPTVYLVTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITG

SEQ ID NO: 2991 - protein, 803 aa, Homo sapiens
MAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQDNLCSPSDILQLNLSVKRTVETLLSLGAHSEESSFVCLSLQLLGFVAFYCTVMLTLCVLYYWLFPAR

SEQ ID NO: 2992 - protein, 210 aa, Homo sapiens
MYKARPPAGSGGPGAEPPAMAAPRGRAAPWTTALLLLLASQVLSPGSCADEEEVPEEWVLLHVVQGQIGAGNYSYLRLNHEGKIVLRMRSLKGDADLYVSASSLHPSFDDYELQSATCGPDAVSIPAHFRRPVGIGVYGHPSHLESEFEMKVYYDGTVEQHPFGEAAYPADGADAGQKHAGAPEDASQEEESVLWTILISILKLVLEILF

SEQ ID NO: 2993 - protein, 161 aa, Homo sapiens
  MOD_RES (1)..(1): Any amino acid
XCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIKPEDTMKAWWPRESYNPRSSWKAEVFR

SEQ ID NO: 2994 - protein, 961 aa, Homo sapiens; identical to SEQ ID NO: 2513

SEQ ID NO: 2995 - protein, 950 aa, Homo sapiens; identical to SEQ ID NO: 1839

SEQ ID NO: 2996 - protein, 116 aa, Homo sapiens; identical to SEQ ID NO: 2491

SEQ ID NO: 2997 - protein, 416 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQGFRGQGVSSNMREISKEGNRLLGGSGDNYRNSETSPGMFNFDTFWKNFKSKLGFINWDAINKDQRSSRIP

SEQ ID NO: 2998 - protein, 310 aa, Homo sapiens
MVDKDTERDIEMKRQLRRLRELHLYSTWKKYQEAMKTSLGVPQCERDEGSLGKPLCPPEILSETLPGSVKKRVCFPSEDHLEEFIAEHLPEASNQSLLTVAHADAGTQTNGDLEDLEEHGPGQTVSEEATEVHTMEGDPDTLAEFLIRDVLQELSSYNGEEEDPEEVKTSLGVPQRGDLEDLEEHVPGQTVSEEATGVHMMQVDPATLAKSDLEDLEEHVPEQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 2999 - protein, 49 aa, Homo sapiens
MAPPSVPLVLLLVLLLSLAETPASAPAHRSSTFPKWVTKTERGRQPLRS

SEQ ID NO: 3000 - protein, 325 aa, Homo sapiens; identical to SEQ ID NO: 1911

SEQ ID NO: 3001 - protein, 129 aa, Homo sapiens; identical to SEQ ID NO: 2490

SEQ ID NO: 3002 - protein, 351 aa, Homo sapiens
MAGIPGLLFLLFFLLCAVGQVSPYSAPWKPTWPAYRLPVVLPQSTLNLAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 3003 - protein, 114 aa, Homo sapiens
MERGAGAKLLPLLLLLRATGFTCAQTDGRNGYTAVIEVTSGGPWGDWAWPEMCPDGFFASGFSLKVEPPQGIPGDDTALNGIRLHCARGNVLGNTHVVESQSGRWGAGVEDPLG

SEQ ID NO: 3004 - protein, 274 aa, Homo sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRWPPLECWDLLPPALPGPVWAALGAKEEMAGKDRTVYCPLLMKALGARVGECPGCQSPQRMLPESSRVLLPRCAEGEQPGVQRGKGRMRKAFPALQTPLALPSSAPASPGAGKPSHTGSWLPLRLLKRQHWRWEPWTACKEAVQHLVITEL

SEQ ID NO: 3005 - protein, 145 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDD

SEQ ID NO: 3006 - protein, 188 aa, Homo sapiens; identical to SEQ ID NO: 2489

SEQ ID NO: 3007 - protein, 185 aa, Homo sapiens
MGPAGCAFTLLLLLGISDRDYHSALQEAEVPIIDRQACEQLYNPIGIFLPALEPVIKEDKICAGDTQNMKDSCKGDSGGPLSCHIDGVWIQTGVVSWGLECGKSLPGVYTNVIYYQKWINATISRANNLDFSDFLFPIVLLSLALLRPSCAFGPNTIHRVGTVAEAVACIQGWEENAWRFSPRGR

SEQ ID NO: 3008 - protein, 550 aa, Homo sapiens
PAPASRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 3009 - protein, 271 aa, Homo sapiens
MGIVCAQCSFILLLSIIRARPPPFLFCPLSSQRTESPYKPVHLGLGPTDKVAAIAMARIIDLVPWDDGSTHVYASPAILLPMERQRNQLAGVKQQLYHPALPTLRHMDRDTVKACLPDEHCQSTTYCRKDEFDNAHFTLLGVPNKPLQCLDITATGQKLRNRYHEGKLAPIAPGINRVDWPCFTRAIEDWSHFVSSAGEFKLPCLRKRAEGLSGYAVRYLKPDVTQTWRYCLSQNPSLDRYGQKPLPFDSLNTFRSFGSSYSRVNYLTPWH

SEQ ID NO: 3010 - protein, 580 aa, Homo sapiens; identical to SEQ ID NO: 2253

SEQ ID NO: 3011 - protein, 170 aa, Homo sapiens
MEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRK

SEQ ID NO: 3012 - protein, 346 aa, Homo sapiens
MRLLFLAVLRPHTGNAVTAQRVRAHLEAAGHVCVLKDAFDFESRSEIANLILAENCEAALALHLYRGGRLLQGHRIPFGVIFGGTDVNEDANQAEKNTVMGRVLEEARFAVAFTESMKEMAQAQWPHAKGKVYVQSQGIATTPNAAFNWNTFLQRSEINQSADNLHIFLLICGLRQVKDPLYLVDAFSAWHQEEPNVHLVIVGPEVDPVFTREVKAKVKRAAGVRLIGEMPQEDLHAVVKNCFAVVNSSVSEGMSAAILEAMDLEVPVLARNIPGNAAVVKHEVTGLLFSNPQEFVHLAKRLVSDPALEKEIVVNGREYVRMYHSWQVERDTYQQLIRKLEGSTED

SEQ ID NO: 3013 - protein, 493 aa, Homo sapiens; identical to SEQ ID NO: 2813

SEQ ID NO: 3014 - protein, 117 aa, Homo sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKPGASPRA

SEQ ID NO: 3015 - protein, 526 aa, Homo sapiens
MQGPLLLPGLCFLLSLFGAVTQKTKTSCAKCPPNASCVNNTHCTCNHGYTSGSGQKLFTFPLETCNAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 3016 - protein, 1943 aa, Homo sapiens
  MOD_RES (1)..(1): Any amino acid
XPSLAGRGAGRMAPGALRGGCEQRAPGGGARTAALGPWPWPSPGPAPSPGAAPPRSRKMSGALLWPLLPLLLLLLSARDGVRAAQPQAPGYLIAAPSVFRAGVEEVISVTIFNSPREVTVQAQLVAQGEPVVQSQGAILDKGTIKLKVPTGLRGQALLKVWGRGWQAEEGPLFHNQTSVTVDGRGASVFIQTDKPVYRPQHRVLISIFTVSPNLRPVNEKLEAYILDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALMINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLETKVMALNGKPVGAQYLPSYLSLGSWYSPSQCYLQLQPPSHPLQVGEEAYFSVKSTCPCNFTLYYEVAARGNIVLSGQQPAHTTQQRSKRAAPALEKPIRLTHLSETEPPPAPEAEVDVCVTSLHLAVTPSMVPLGRLLVFYVRENGEGVADSLQFAVETFFENQVSVTYSANETQPGEVVDLRIRAARGSCVCVAAVDKSVYLLRSGFRLTPAQVFQELEDYDVSDSFGVSREDGPFWWAGLTAQRRRRSSVFPWPWGITKDSGFAFTETGLVVMTDRVSLNHRQDGGLYTDEAVPAFQPHTGSLVAVAPSRHPPRTEKRKRTFFPETWIWHCLNISDPSGEGTLSVKVPDSITSWVGEAVALSTSQGLGIAEPSLLKTFKPFFVDFMLPALIIRGEQVKIPLSVYNYMGTCAEVYMKLSVPKGIQFVGHPGKRHVTKKMCVAPGEAEPIWVVLSFSDLGLNNITAKALAYGDTNCCRDGRSSKHPEENHADRRVPIGVDHVRRSVMVEAEGVPRAYTYSAFFCPSERVHISTPNKYEFQYVQRPLRLTRFDVAVRAHNDARVALSSGPQDTAGMIEIVLGGHQNTRSWISTSKMGEPVASAHTAKILSWDEFRTFWISWRGGLIQVGHGPEPSNESVIVAWTLPRPPEVQFIGFSTGWGSMGEFRIWRKMEVDESYSEAFTLGVPHGAIPGSERATASIIGDVMGPTLNHLNNLLRLPFGCGEQNMIHFAPNVFVLKYLQKTQQLSPEVERETTDYLVQGYQRQLTYKRQDGSYSAFGERDASGSMWLTAFVLKSFAQARSFIFVDPRELAAAKSWIIQQQQADGSFLAVGRVLNKDIQGGIHGTVPLTAYVVVALLETGTASEEERGSTDKARHFLESAAPLAMDPYSCALTTYALTLLRSPAAPEALRKLRSLAIMRDGVTHWSLSNSWDVDKGTFLSFSDRVSQSVVSAEVEMTAYALLTYTLLGDVAAALPVVKWLSQQRNALGGFSSTQDTCVALQALAEYAILSYAGGINLTVSLASTNLDYQETFELHRTNQKVLQTAAIPSLPTGLFVSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALEQRLPASSSSTYGDDLASVAPGPLQQDVKLNGAGLEVEDSDPEPEGEAEDRVTAGPRPPVSSGNLESSTQSASPFHRWGQTPAPQRHSGRVVGAHRPGLLSPVFVYSPAFQSGGEEGLWMSNTCTLR

SEQ ID NO: 3017 - protein, 151 aa, Homo sapiens
MEATGTDEVDKLKTKFISAWNNMKYSWVLKTKTYFSRNSPVLLLGKCYHFKYEDEDKTLPAESGCTIEDHVIAGNVEEFRKDFISRIWLTYREEFPQIEGSALTTDCGWGCTLRTGQMLLAQGLILHFLGRAWTWPDALNIENSDSESWTS

SEQ ID NO: 3018 - protein, 871 aa, Homo sapiens
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDGRSLLLPFEDRGDLEPLELVWAKCRGYPSYPALIIDPKMPREGLLHNGVPIPVPPLDVLKLGEQKQAEAGEKLFLVLFFDNKRTWQWLPRDKVLPLGVEDTVDKLKMLEGRKTSIRKSVQVAYDRAMIHLSRVRGPHSFVTSSYL

SEQ ID NO: 3019 - protein, 899 aa, Homo sapiens; identical to SEQ ID NO: 2512

SEQ ID NO: 3020 - protein, 178 aa, Homo sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLE

SEQ ID NO: 3021 - protein, 727 aa, Homo sapiens
MILSLLFSLGGPLGWGLLGAWAQASSTSLSDLQSSRTPGVWKAEAEDTGKDPVGRNWCPYPMSKLVTLLALCKTEKFLIHSQQPCPQGAPDCQKVKVMYRMAHKPVYQVKQKVLTSLAWRCCPGYTGPNCEHHGPMAVWCWPEPDSLQARLGQLQRNLSELHMTTARREEELQYTLEDMRATLTRHVDEIKELYSESDETFDQISKVERQVEELQVNHTALRELRVILMEKSLIMEENKEEVERQLLELNLTLQHLQGGHADLIKYVKDCNCQKLYLDLDVIREGQRDATRALEETQVSLDERRQLDGSSLQALQNAVDAVSLAVDAHKAEGERARAATSRLRSQVQALDDEVGALKAAAAEARHEVRQLHSAFAALLEDALRHEAVLAALFGEEVLEEMSEQTPGPLPLSYEQIRVALQDAASGLQEQALGWDELAARVTALEQASEPPRPAEHLEPSHDAGREEAATTALAGLARELQSLSNDVKNVGRCCEAEAGAGAASLNASLHGLHNALFATQRSLEQHQRLFHSLFGNFQGLMEANVSLDLGKLQTMLSRKGKKQQKDLEAPRKRDKKEAEPLVDIRVTGPVPGALGAALWEAGSPVAFYASFSEGTAALQTVKFNTTYINIGSSYFPEHGYFRAPERGVYLFAVSVEFGPGPGTGQLVFGGHHRTPVCTTGQGSGSTATVFAMAELQKGERVWFELTQGSITKRSLSGTAFGGFLMFKT

SEQ ID NO: 3022 - protein, 275 aa, Homo sapiens
MGSAPWAPVLLLALGLRGLQAGGEWRRPPAHSPVPAPPLRFASPHSPQGPGPRLPGALLPAASGPLQLRALRQQDLPSALPGVGQVLGPGRGAHLLLHWERGRRVGLRQQLGLRRGAGGRAGGSTGLRGAPLLREVAAVRCAVHAARAHGAADGGAGPGRLRRAAPRATTRPRGPGCPRHRLRWKLWGDAQCLPEDEVSPPGGGGAGGQRARSSCGRPRRLQPVLPGRHGGSLRHGPLGVRHLPAAVRREGPDPALHVRPECLHRAGHDGLPLPH

SEQ ID NO: 3023 - protein, 116 aa, Homo sapiens; identical to SEQ ID NO: 2491

SEQ ID NO: 3024 - protein, 173 aa, Homo sapiens; identical to SEQ ID NO: 2208

SEQ ID NO: 3025 - protein, 493 aa, Homo sapiens
SEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTLLPVSPMALRCCSPIQPTASFWPLTPVPLEARAPPHPPGPNPPTPRGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLN

SEQ ID NO: 3026 - protein, 212 aa, Homo sapiens
MGLHLRPYRVGLLPDGLLFLLLLLMLLADPALPAGRHPPVVLGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 3027 - protein, 217 aa, Homo sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTG

SEQ ID NO: 3028 - protein, 114 aa, Homo sapiens
MKTFTWTLGVLFFLLVDTGHCRGGQFKIKKINQRRYPRATDGKEEAKKCAYTFLVPEQRITGPICVNTKGQDASTIKDMITRMDLENLKDVLSRQKREIDVLQLVVDVDGNIVN

SEQ ID NO: 3029 - protein, 289 aa, Homo sapiens; identical to SEQ ID NO: 2923

SEQ ID NO: 3030 - protein, 333 aa, Homo sapiens; identical to SEQ ID NO: 2641

SEQ ID NO: 3031 - protein, 176 aa, Homo sapiens
MRLLILTCLVAVALARPKLPLRYPERLQNPSESSEPIPLESREEYMNGMNRRNILREKQTDEIKDTRNESTQNCVVAEPEKMESSISSSSEEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 3032 - protein, 92 aa, Homo sapiens
MKLCVTVLSLLVLVAAFCSLALSAPMGSDPPTACCFSYTARKLPRNFVVDYYETSSLCSQPAVVFQTKRGKQVCADPSESWVQEYVYDLELN

SEQ ID NO: 3033 - protein, 551 aa, Homo sapiens
MTWRMGPRFTMLLAMWLVCGSEPHPHATIRGSHGGRKVPLVSPDSSRPARFLRHTGRSRGIERSTLEEPNLQPLQRRRSVPVLRLARPSRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 3034 - protein, 414 aa, Homo sapiens; identical to SEQ ID NO: 2732

SEQ ID NO: 3035 - protein, 99 aa, Homo sapiens; identical to SEQ ID NO: 2873

SEQ ID NO: 3036 - protein, 303 aa, Homo sapiens; identical to SEQ ID NO: 2022

SEQ ID NO: 3037 - protein, 147 aa, Homo sapiens; identical to SEQ ID NO: 2688

SEQ ID NO: 3038 - protein, 390 aa, Homo sapiens; identical to SEQ ID NO: 2401

SEQ ID NO: 3039 - protein, 98 aa, Homo sapiens
MNKHFLFLFLLYCLIVAVTSLQCITCHLRTRTDRCRRGFGVCTAQKGEACMLLRIYQRNTLQISYMVCQKFCRDMTFDLRNRTYVHTCCNYNYCNFKL

SEQ ID NO: 3040 - protein, 199 aa, Homo sapiens
MAWGGVHTCCFHLCCCCSWPQGAVPEELHKHPGQTLLLQCQYSPKRGPYQPKSWCQQTSPSRCTLLVTSSKPWTAVQKSHYTIWDKPNAGFFNITMIQLTQNDSGFYWCGIYNASENIITVLRNISLVVSPAPTTSPMWTLPWLPTSTAWEPQIQEIKFRAPTDSTLWKSRAPACLGSGGPRFLVLVLCGLLLAKGLML

SEQ ID NO: 3041 - protein, 674 aa, Homo sapiens
MTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGLHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 3042 - protein, 245 aa, Homo sapiens
MQAAWLLGALVVPQLLGFGHGARGAEREWEGGWGGAQEEEREREALMLKHLQEALGLPAGRGDENPAGTVEGKEDWEMEEDQGEEEEEEATPTPSSGPSPSPTPEDIVTYILGRLAGLDAGLHQLHVRLHALDTRVVELTQGLRQLRNAAGDTRDAVQALQEAQGRAEREHGRLEGCLKGLRLGHKCFLLSRDFEAQPSASPHPLSPDQPNGGTLENCVAQASDDGSWWDHDCQRRLYYVCEFPF

SEQ ID NO: 3043 - protein, 92 aa, Homo sapiens
MIWRSRAGAELFSLMALWEWIALSLHCWVLAVAAVSDQHATSPFDWLLSDKGPFHRSQEYTDFVDRSRQGFSTRYKIYRNMGHISCYLLLWE

SEQ ID NO: 3044 - protein, 58 aa, Homo sapiens
MADMQNLVERLERAVGRLEAVSHTSDMHRGYADSPSKAGAAPYVQAFDSLLAGPVAEY

SEQ ID NO: 3045 - protein, 243 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDCSMGVWASWQMVWWGWMTLGRVRSCGSGQAMTMWDGATTASPVAMWRWSLSLTG

SEQ ID NO: 3046 - protein, 844 aa, Homo sapiens; identical to SEQ ID NO: 2289

SEQ ID NO: 3047 - protein, 306 aa, Homo sapiens
RRTCAGPGRAGGARSASWMSRLRALLGLGLLVAGSRVPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGWDVEKGNAGGIQPDLLISLTAPKKSATQFTGRYHYLGGRFVPPALEKKYQLNLPPYPDTECVYRLQ

SEQ ID NO: 3048 - protein, 378 aa, Homo sapiens; identical to SEQ ID NO: 2828
  MOD_RES (1)..(1): Any amino acid

SEQ ID NO: 3049 - protein, 253 aa, Homo sapiens
MAPWSHPSAQLQPVGGDAVSPALMVLLCLGNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGEEATVFSSTIQGSQTGCGELYRQGSPC

SEQ ID NO: 3050 - protein, 95 aa, Homo sapiens
MRKPRRKSRQNAEGRRSPSPYSLKCSPTRETLTYAQAQRIVEVDIDGRLHRISIYDPLKIITEDELTAQDITECNSNKENSEQPQFPGKSKKPSS

SEQ ID NO: 3051 - protein, 436 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKDQRSSRIP

SEQ ID NO: 3052 - protein, 79 aa, Homo sapiens
MPACRLGPLAAALLLSLLLFGFTLVSGTGAEKTGVCPELQADQNCTQECVSDSECADNLKCCSAGCATFCSLPNGQLAE

SEQ ID NO: 3053 - protein, 709 aa, Homo sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGLHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 3054 - protein, 688 aa, Homo sapiens [sequence omitted]

SEQ ID NO: 3055 - protein, 418 aa, Homo sapiens
NNLNVGSDTTSETSFSLSKEAPREHLDHQAAHQPFPRPRFRQETGHPSLQRDFPRSFLLDLPNFPDLSKADINGQNPNIQVTIEVVDGPDSEADKDQHPENKPSWSVPSPDWRAWWQRSLSLARANSGDQDYKYDSTSDDSNFLNPPRGWDHTAPGHRTFETKDQPEYDSTDGEGDWSLWSVCSVTCGNGNQKRTRSCGYACTATESRTCDRPNCPGIEDTFRTAATEVSLLAGSEEFNATKLFEVDTDSCERWMSCKSEFLKKYMHKVMNDLPSCPCSYPTEVAYSTADIFDRIKRKDFRWKDASGPKEKLEIYKPTARYCIRSMLSLESTTLAAQHCCYGDNMQLITRGKGAGTPNLISTEFSAELHYKVDVLPWIICKGDWSRYNEARPPNNGQKCTESPSDEDYIKQFQEAREY

SEQ ID NO: 3056 - protein, 230 aa, Homo sapiens; identical to SEQ ID NO: 2328

SEQ ID NO: 3057 - protein, 63 aa, Homo sapiens; identical to SEQ ID NO: 2934

SEQ ID NO: 3058 - protein, 337 aa, Homo sapiens
MLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 3059 - protein, 111 aa, Homo sapiens
MFFTISRKNMSQKLSLLLLVFGLIWGLMLLHYTFQQPRHQSSVKLREQILDLSKRYVKALAEENKNTVDVENGASMAGYADLKRTIAVLLDDILQRLVKLENKVDYIVVNG

SEQ ID NO: 3060 - protein, 165 aa, Homo sapiens; identical to SEQ ID NO: 2045

SEQ ID NO: 3061 - protein, 232 aa, Homo sapiens
MVLLLVILIPVLVSSAGTSAHYEMLGTCRMVCDPYGGTKAPSTAATPDRGLMQSLPTFIQGPPMGPPGEKGEPGRQGLPGPPGAPGLNAAGAISAATYSTVPKIAFYAGLKRQHEGYEVLKFDDVVTNLGNHYDPTTGKFTCSIPGIYFFTYHVLMRGGDGTSMWADLCKNNQVRASAIAQDADQNYDYASNSVVLHLEPGDEVYIKLDGGKAHGGNNNKYSTFSGFIIYAD

SEQ ID NO: 3062 - protein, 166 aa, Homo sapiens; identical to SEQ ID NO: 2963

SEQ ID NO: 3063 - protein, 208 aa, Homo sapiens
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANISLDGWEENHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 3064 - protein, 746 aa, Homo sapiens
MPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 3065 - protein, 200 aa, Homo sapiens; identical to SEQ ID NO: 2236

SEQ ID NO: 3066 - protein, 37 aa, Homo sapiens
MGWLTRIVCLFWGVLLTARANYQNGKNNVPRLKLSYK

SEQ ID NO: 3067 - protein, 174 aa, Homo sapiens
MRLLAFLSLLALVLQETGTASLPRKERKRREEQMPREGDSFEVLPLRNDVLNPDNYGEVIDLSNYEELTDYGDQLPEVKVTSLAPATSISPAKSTTAPGTPSSNPTMTRPTTAGLLLSSQPNHEDIPPLPRRTAYLYARFNRISRIRAEDFKGLTKLKRIDLSNNLISSIDNDA

SEQ ID NO: 3068 - protein, 218 aa, Homo sapiens; identical to SEQ ID NO: 2537

SEQ ID NO: 3069 - protein, 844 aa, Homo sapiens; identical to SEQ ID NO: 2289

SEQ ID NO: 3070 - protein, 668 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLIVGILLVLMAVVLASLIYRRRLMKQDFSVPQLPHSSSHWLRLPRIFCSCPIGENSPLLSGQQV

SEQ ID NO: 3071 - protein, 174 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKD

SEQ ID NO: 3072 - protein, 455 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQARAALCGTPTPSLASGLWRTLQVGWNMQLLPAGLVSFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGLVWLSAAMGFGNCVELQASAAFNWNDQRCKTRNRYICQFAQEHISRWGPGS

SEQ ID NO: 3073 - protein, 98 aa, Homo sapiens
MVLAMLGALHPRAGLSLFLHLILAVALLRSQPLRSQRSVPEAFSAPLELSQPLSGLVDDYGILPKHPRPRGPRPLLSRAQQRKRDGPDLAEYYYDAHL

SEQ ID NO: 3074 - protein, 913 aa, Homo sapiens; identical to SEQ ID NO: 2128

SEQ ID NO: 3075 - protein, 225 aa, Homo sapiens; identical to SEQ ID NO: 2797
  MOD_RES (1)..(1): Any amino acid

SEQ ID NO: 3076 - protein, 134 aa, Homo sapiens
MPRCRWLSLILLTIPLALVARKDPKKNETGVLRKLKPVNASNANVKQCLWFAMQEYNKESEDKYVFLVVKTLQAQLQVTNLLEYLIDVEIARSDCRKPLSTNEICAIQENSKLKRKLSCSFLVGALPWNGEFTV

SEQ ID NO: 3077 - protein, 393 aa, Homo sapiens; identical to SEQ ID NO: 2122

SEQ ID NO: 3078 - protein, 225 aa, Homo sapiens; identical to SEQ ID NO: 2797
  MOD_RES (1)..(1): Any amino acid

SEQ ID NO: 3079 - protein, 469 aa, Homo sapiens
MMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 3080 - protein, 378 aa, Homo sapiens; identical to SEQ ID NO: 2828
  MOD_RES (1)..(1): Any amino acid

SEQ ID NO: 3081 - protein, 225 aa, Homo sapiens; identical to SEQ ID NO: 2797
  MOD_RES (1)..(1): Any amino acid

SEQ ID NO: 3082 - protein, 281 aa, Homo sapiens; identical to SEQ ID NO: 2231

SEQ ID NO: 3083 - protein, 369 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGNSETSPGMFNFDTFWKNFKSKLGFINWDAINKDQRSSRIP

SEQ ID NO: 3084 - protein, 139 aa, Homo sapiens; identical to SEQ ID NO: 2817

SEQ ID NO: 3085 - protein, 171 aa, Homo sapiens
MRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTPLPVSPMALVHLCEVDSPQD

SEQ ID NO: 3086 - protein, 63 aa, Homo sapiens; identical to SEQ ID NO: 2934

SEQ ID NO: 3087 - protein, 378 aa, Homo sapiens; identical to SEQ ID NO: 2828
  MOD_RES (1)..(1): Any amino acid

SEQ ID NO: 3088 - protein, 844 aa, Homo sapiens; identical to SEQ ID NO: 2289

SEQ ID NO: 3089 - protein, 112 aa, Homo sapiens
MLTAALAPGAANSPTTNPVILIVDKVLETQDLNGDGLMTPAELINFPGVALRPYPPYIGVGPNSNMCSRSDLPEDSNTLYPGSHLWLRHALNSKGNLDARLDGGEKAMQPQW

SEQ ID NO: 3090 - protein, 891 aa, Homo sapiens; identical to SEQ ID NO: 2482

SEQ ID NO: 3091 - protein, 913 aa, Homo sapiens; identical to SEQ ID NO: 2128

SEQ ID NO: 3092 - protein, 129 aa, Homo sapiens; identical to SEQ ID NO: 2490

SEQ ID NO: 3093 - protein, 281 aa, Homo sapiens; identical to SEQ ID NO: 2231

SEQ ID NO: 3094 - protein, 147 aa, Homo sapiens; identical to SEQ ID NO: 2688

SEQ ID NO: 3095 - protein, 876 aa, Homo sapiens; identical to SEQ ID NO: 1912

SEQ ID NO: 3096 - protein, 582 aa, Homo sapiens
MDFLLALVLVSSLYLQAAAEFDGRWPRQIVSSIGLCRYGGRIDCCWGWARQSWGQCQPFYVLRQRIARIRCQLKAVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 3097 - protein, 533 aa, Homo sapiens
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLLHASLSSPGGEDAWLIGVGGSVPSGVAVRCPVCLEAPLVSGCLLQTPGALDPGTAGPPHPTGCCSGPHLPAPTVRPGPSAASAPPARGGLGGAAAPGGSAG

SEQ ID NO: 3098 - protein, 430 aa, Homo sapiens
MGVSKLDILYRRLLLTKLFIRGWGRPEDLKRLFEFRKMIGNRERCQNLVSSDYPVHIDKIEEQSDCKILDGHFVSPMAHYVPDIMPIESVIARFQFIVPKEWNSKYRPVCIHLAGTGDHHYWRRRTLMARPMIKEARMASLLLENPYYGCRKPKDQVRSSLKNVSDLFVMGGALVLESAALLHWLEREGYGPLGMTGISMGGHMASLAVSNWPKPMPLIPCLSWSTASGVFTTTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFRQAIYDAFDRFLHKYAN

SEQ ID NO: 3099 - protein, 876 aa, Homo sapiens; identical to SEQ ID NO: 1912

SEQ ID NO: 3100 - protein, 78 aa, Homo sapiens; identical to SEQ ID NO: 2320

SEQ ID NO: 3101 - protein, 876 aa, Homo sapiens; identical to SEQ ID NO: 1912

SEQ ID NO: 3102 - protein, 418 aa, Homo sapiens; identical to SEQ ID NO: 2199

SEQ ID NO: 3103 - protein, 129 aa, Homo sapiens
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPE

SEQ ID NO: 3104 - protein, 104 aa, Homo sapiens
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKF

SEQ ID NO: 3105 - protein, 212 aa, Homo sapiens; identical to SEQ ID NO: 2980

SEQ ID NO: 3106 - protein, 334 aa, Homo sapiens
MLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNTGIVFGAILGAILGVSLLTLVGYLLCGKRKTDSFSHRRLYDDRNEPVLRLDNAPEPYDVSFGNSSYYNPTLNDSAMPESEENARDGIPMDDIPPLRTSV

SEQ ID NO: 3107 - protein, 328 aa, Homo sapiens
MGPAGCAFTLLLLLGISVCGQPVYSSRVVGGQDAAAGRWPWQVSLHFDHNFICGGSLVSERLILTAAHCIQPTWTTFSYTVWLGSITVGDSRKRVKYYVSKIVIHPKYQDTTADVALLKLSSQVTFTSAILPICLPSVTKQLAIPPFCWVTGWGKVKESSDRDYHSALQEAEVPIIDRQACEQLYNPIGIFLPALEPVIKEDKICAGDTQNMKDSCKGDSGGPLSCHIDGVWIQTGVVSWGLECGKSLPGVYTNVIYYQKWINATISRANNLDFSDFLFPIVLLSLALLRPSCAFGPNTIHRVGTVAEAVACIQGWEENAWRFSPRGR

SEQ ID NO: 3108 - protein, 150 aa, Homo sapiens; identical to SEQ ID NO: 2126

SEQ ID NO: 3109 - protein, 77 aa, Homo sapiens
MRVAGAAKLVVAVAVFLLTFYVISQVFEIKMDASLGNLFARSALDTAARSTKPPRYKCGISKACPEKHFAFKMASGA

SEQ ID NO: 3110 - protein, 380 aa, Homo sapiens; identical to SEQ ID NO: 2413

SEQ ID NO: 3111 - protein, 185 aa, Homo sapiens
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQ

SEQ ID NO: 3112 - protein, 124 aa, Homo sapiens
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYA

SEQ ID NO: 3113 - protein, 1952 aa, Homo sapiens; identical to SEQ ID NO: 2311

SEQ ID NO: 3114 - protein, 203 aa, Homo sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGKCSRVIESKPSESMNTRRVLGDSGEINILTGQAPLALAIF

SEQ ID NO: 3115 - protein, 836 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 3116 - protein, 436 aa, Homo sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 3117 - protein, 313 aa, Homo sapiens; identical to SEQ ID NO: 2235

SEQ ID NO: 3118 - protein, 70 aa, Homo sapiens
MVAPAARVFLRAVRAALTSTVPDLLCLLARGSPRGLASGRLPLAVHSAQHGPGSGAPWLRIARRALSQRI

SEQ ID NO: 3119 - protein, 213 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTV

SEQ ID NO: 3120 - protein, 78 aa, Homo sapiens; identical to SEQ ID NO: 2320

SEQ ID NO: 3121 - protein, 216 aa, Homo sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGT

SEQ ID NO: 3122 - protein, 150 aa, Homo sapiens; identical to SEQ ID NO: 2126

SEQ ID NO: 3123 - protein, 56 aa, Homo sapiens
MKTGLFFLCLLGTAAAIPTNARLLSDHSKPTAETVAPDNTAIPSLRAEAEENEKET

SEQ ID NO: 3124 - protein, 781 aa, Homo sapiens
MAVAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 3125 - protein, 72 aa, Homo sapiens
MAAATRGCRPWGSLLGLLGLVSAAAAAWDLASLRCTLGAFCECDFRPDLPEGSEELGPREPHCLWPLPLPLR

SEQ ID NO: 3126 - protein, 80 aa, Homo sapiens
MKVFFLFAVLFCLVQTNSGDVPPGIRNTICHMQQGICRLFFCHSGEKKRDICSDPWNRCCVSNTDEEGKEKPEMDGRSGI

SEQ ID NO: 3127 - protein, 286 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVH

SEQ ID NO: 3128 - protein, 285 aa, Homo sapiens
MRGQGRKESLSDSRDLDGSYDQLTGHPPGPTKKALKQRFLKLLPCCGPQALPSVSEIGRVFRFLGDSSLPSALAAPASLRPHRPRLLDPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 3129 - protein, 436 aa, Homo sapiens; identical to SEQ ID NO: 2285

SEQ ID NO: 3130 - protein, 405 aa, Homo sapiens; identical to SEQ ID NO: 1930

SEQ ID NO: 3131 - protein, 99 aa, Homo sapiens
MLALLVLVTVALASAHHGGEHFEGEKVFRVNVEDENHINIIRELASTTQIDFWKPDSVTQIKPHSTVDFRVKAEDTVTVENVLKQNELQYKVLISNLRN

SEQ ID NO: 3132 - protein, 156 aa, Homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPH

SEQ ID NO: 3133 - protein, 82 aa, Homo sapiens
MGRVFLTGEKANSILKRYPRANGFFEEIRQGNIERECKEEFCTFEEAREAFENNEKTGLVLLPRLECSCEHGSLQPQLPVPK

SEQ ID NO: 3134 - protein, 123 aa, Homo sapiens
MQGTPGGGTRPGPSPVDRRTLLVFSFILAAALGQMNFTGDQVLRVLAKDEKQLSLLGDLEGLKPQKVDFWRGPARPSLPVDMRVPFSELKDIKAYLESHGLAYSIMIKDIQVLLDEERQAMAK

SEQ ID NO: 3135 - protein, 279 aa, Homo sapiens
MGRVFLTGEKANSILKRYPRANGFFEEIRQGNIERECKEEFCTFEEAREAFENNEKTITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 3136 - protein, 187 aa, Homo sapiens
MWCASPVAVVAFCAGLLVSHPVLTQGQEAGGRPGADCEVCKEFLNRFYKSLIDRGVNFSLDTIEKELISFCLDTKGKENRLCYYLGATKDAATKILSEVTRPMSVHMPAMKICEKLKKLDSQICELKYEKTLDLASVDLRKMRVAELKQILHSWGEECRACAEKTDYVNLIQELAPKYAATHPKTEL

SEQ ID NO: 3137 - protein, 436 aa, Homo sapiens; identical to SEQ ID NO: 2285

SEQ ID NO: 3138 - protein, 149 aa, Homo sapiens
MGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQTVTEGHIPFPQHLNIITPPPPPDEVFDSSGLSPGFL

SEQ ID NO: 3139 - protein, 311 aa, Homo sapiens
MLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 3140 - protein, 206 aa, Homo sapiens
MDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKK

SEQ ID NO: 3141 - protein, 405 aa, Homo sapiens; identical to SEQ ID NO: 1930

SEQ ID NO: 3142 - protein, 132 aa, Homo sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQAT

SEQ ID NO: 3143 - protein, 201 aa, Homo sapiens; identical to SEQ ID NO: 2486

SEQ ID NO: 3144 - protein, 361 aa, Homo sapiens
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDGCSSHNTATAVAALGGFLYILAEYPPANREPHPSTPPPPSSR

SEQ ID NO: 3145 - protein, 53 aa, Homo sapiens
MWTNFFKLRLFCCLLAVLMVVVLVINVTQVEYLDHETVSATFIDSSGQFVSSQ

SEQ ID NO: 3146 - protein, 434 aa, Homo sapiens
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENSVTGHPVFYLPLCDSFLPPKAAPVTELYTDGPVMFCGMGGFSDFYKLRWLEAILSWQKQQEGCFGEPDAEDEELSKAIQYQQHFSRRVKRREKQFPDSRSVAQAGVQWRNLGSLQPLPPGFKQFSCLILPSSWDYRSVPPYLANFYIFLVETGFHHVAHAGLELLISRDPPTSGSQSVGL

SEQ ID NO: 3147 - protein, 436 aa, Homo sapiens; identical to SEQ ID NO: 2285

SEQ ID NO: 3148 - protein, 405 aa, Homo sapiens; identical to SEQ ID NO: 1930

SEQ ID NO: 3149 - protein, 169 aa, Homo sapiens
MLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYA

SEQ ID NO: 3150 - protein, 402 aa, Homo sapiens
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDSRSVAQAGVQWRNLGSLQPLPPGFKQFSCLILPSSWDYRSVPPYLANFYIFLVETGFHHVAHAGLELLISRDPPTSGSQSVGL

SEQ ID NO: 3151 - protein, 559 aa, Homo sapiens; identical to SEQ ID NO: 1951

SEQ ID NO: 3152 - protein, 133 aa, Homo sapiens [sequence omitted]

SEQ ID NO: 3153 - protein, 201 aa, Homo sapiens; identical to SEQ ID NO: 2486

SEQ ID NO: 3154 - protein, 201 aa, Homo sapiens; identical to SEQ ID NO: 2486

SEQ ID NO: 3155 - protein, 243 aa, Homo sapiens; identical to SEQ ID NO: 3045

SEQ ID NO: 3156 - protein, 85 aa, Homo sapiens
MKIPVLPAVVLLSLLVLHSAQGATLGGPEEESTIENYASRPEAFKADEFLNWHALFESIKRKLPFLNWDAFPKLKGLRSATPDAQ

SEQ ID NO: 3157 - protein, 115 aa, Homo sapiens
MGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQTV

SEQ ID NO: 3158 - protein, 201 aa, Homo sapiens; identical to SEQ ID NO: 2486

SEQ ID NO: 3159 - protein, 436 aa, Homo sapiens; identical to SEQ ID NO: 2285

SEQ ID NO: 3160 - protein, 201 aa, Homo sapiens
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLA

SEQ ID NO: 3161 - protein, 24 aa, Homo sapiens
MLVDGPSERPALCFLLLAVAMSFF

SEQ ID NO: 3162 - protein, 83 aa, Homo sapiens
MRPRGLPPLLVVLLGCWASVSAQTDATPAVTTEGLNSTEAALATFGTFPSTRPPGTPRAPGPSSGPRPTPVTDGSHSVTQAGV

SEQ ID NO: 3163 - protein, 417 aa, Homo sapiens; identical to SEQ ID NO: 1973

SEQ ID NO: 3164 - protein, 559 aa, Homo sapiens; identical to SEQ ID NO: 1951

SEQ ID NO: 3165 - protein, 32 aa, Homo sapiens
MQGTPGGGTRPGPSPVDRRTLLVFSFILAAAL

SEQ ID NO: 3166 - protein, 59 aa, Homo sapiens
MLALLVLVTVALASAHHGGEHFEGEKVFRVNVEDENHINIIRELASTTQIDFWKPDSVT

SEQ ID NO: 3167 - protein, 100 aa, Homo sapiens
MRPRGLPPLLVVLLGCWASVSAQTDATPAVTTEGLNSTEAALATFGTFPSTRPPGTPRAPGPSSGPRPTPVTDGGYHVPAPGVHSDPTSRGQPRCCSLCL

SEQ ID NO: 3168 - protein, 77 aa, Homo sapiens
MRSPRMRVCAKSVLLSHWLFLAYVLMVCCKLMSASSQHLRGHAGHHQIKQGTCEVVAVHRCCNKNRIEERSQTVKCS

SEQ ID NO: 3169 - protein, 3 aa, Homo sapiens
MWT

SEQ ID NO: 3170 - protein, 133 aa, Homo sapiens [sequence omitted]

SEQ ID NO: 3171 - protein, 199 aa, Homo sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWVRSPRRGLQEQEELCFHMWGGKGGLCQSSL

SEQ ID NO: 3172 - protein, 347 aa, Homo sapiens
MGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 3173 - protein, 8 aa, Homo sapiens
MQGTPGGG

SEQ ID NO: 3174 - protein, 122 aa, Homo sapiens
MLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLA

SEQ ID NO: 3175 - protein, 102 aa, Homo sapiens
MRVSGVLRLLALIFAIVTTWMFIRSYMSFSMKTIRLPRWLAASPTKEIQVKKYKCGLIKPCPANYFAFKICSGAANVVGPTMCFEDRMIMSPVKNNVGRGLN

SEQ ID NO: 3176 - protein, 219 aa, Homo sapiens; identical to SEQ ID NO: 2252

SEQ ID NO: 3177 - protein, 622 aa, Homo sapiens
MGKSEGPVGMVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKYRVLGSLQNLAAFADTFHCARGTPMHPKERCRVW

SEQ ID NO: 3178 - protein, 55 aa, Homo sapiens
MGPEALSSLLLLLLVASGDADMKGHFDPAKCRYALGMQDRTIPDSDISASSSWSD

SEQ ID NO: 3179 - protein, 51 aa, Homo sapiens
MGPEALSSLLLLLLVASGDADMKGHFDPAKCRYALGMQDRTIPDSDISASS

SEQ ID NO: 3180 - protein, 539 aa, Homo sapiens; identical to SEQ ID NO: 2982

SEQ ID NO: 3181 - protein, 196 aa, Homo sapiens
MPHLASLFTASSRCCPHPLRPEGSGAMGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRA

SEQ ID NO: 3182 - protein, 53 aa, Homo sapiens
MLPCLALLLLMELSVCTVAGDGGEEQTLSTEAETWVIVALEVLLGRGSDEGRG

SEQ ID NO: 3183 - protein, 41 aa, Homo sapiens
MGPEALSSLLLLLLVASGDADMKGHFDPAKCRYALGMQDRT

SEQ ID NO: 3184 - protein, 73 aa, Homo sapiens
MGPEALSSLLLLLLVASGDADMKGHFDPAKCRYALGMQDRTIPDSDISASSSWSDSTAARHSRLESSDGDGAW

SEQ ID NO: 3185 - protein, 122 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRY

SEQ ID NO: 3186 - protein, 160 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMV

SEQ ID NO: 3187 - protein, 179 aa, Homo sapiens
MGSSGLLSLLVLFVLLANVQGPGLTDWLFPRRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKQPCPKIKVECEVEEIDQCTKPRDCPENMKCCPFSRGKKCLDFRKASLST

SEQ ID NO: 3188 - protein, 145 aa, Homo sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFE

SEQ ID NO: 3189 - protein, 132 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGW

SEQ ID NO: 3190 - protein, 101 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVG

SEQ ID NO: 3191 - protein, 130 aa, Homo sapiens; identical to SEQ ID NO: 2082

SEQ ID NO: 3192 - protein, 139 aa, Homo sapiens
MPAIAVLAAAAAAWCFLQVESRHLDALAGGAGPNHGNFLDNDQWLSTVSQYDRDKYWNRFRDDDYFRNWNPNKPFDQALDPSKDPCLKVKCSPHKVCVTQDYQTALCVSRKHLLPRQKKGNVAQKHWVGPSNLVKCKPC

SEQ ID NO: 3193 - protein, 169 aa, Homo sapiens
MRLLILTCLVAVALARPKLPLRYPERLQNPSESSEPIPLESREEYMNGMNRQRNILREKQTDEIKNCVVAEPEKMESSISSSSEEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 3194 - protein, 306 aa, Homo sapiens
MKKDEPPLDFPDTLEGFEYAFNEKGQLRHIKTGEPFVFNYREDLHRWNQKRYEALGEIITKYVYELLEKDCNLKKVSIPEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 3195 - protein, 953 aa, Homo sapiens
  MOD_RES (1)..(1): Any amino acid
XQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPQDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEVNFPTPIQTISQGSKP

SEQ ID NO: 3196 - protein, 152 aa, Homo sapiens; identical to SEQ ID NO: 2696

SEQ ID NO: 3197 - protein, 566 aa, Homo sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDEHIPAPLDQGSEQPLFQPLDHQATSLPSRDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 3198 - protein, 70 aa, Homo sapiens
MGPEALSSLLLLLLVASGDADMKGHFDPAKCRYALGMQDRTIPDSDISASSSWSDSTAARHSRLESSDGD

SEQ ID NO: 3199 - protein, 78 aa, Homo sapiens
MGPEALSSLLLLLLVASGDADMKGHFDPAKCRYALGMQDRTIPDSDISASSSWSDSTAARHSRLESSDGDGAWCPAGS

SEQ ID NO: 3200 - protein, 112 aa, Homo sapiens
MRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTN

SEQ ID NO: 3201 - protein, 894 aa, Homo sapiens
MSLPRCCPHPLRPEGSGAMGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 3202 - protein, 127 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGR

SEQ ID NO: 3203 - protein, 370 aa, Homo sapiens
MKKDEPPLDFPDTLEGFEYAFNEKGQLRHIKTGEPFVFNYREDLHRWNQKRYEALGEIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 3204 - protein, 144 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPG

SEQ ID NO: 3205 - protein, 446 aa, Homo sapiens
LTLHSLTCYEDLVTFLQQSIHQFEVGPYGCILLTLSAILSRSTELIRQDFDVPTSHLIGAHGYCTQELVNLLLTGKAVSNVFNDVVELDSGDGNITLLRGIAARSDIGFLSLFEHYNMCQVGCFLKTPRFPIWVVCSESHFSILFSLQPGLLRDWRTERLFDLYYYDGLANQQEQIRLTIDTTQTISEDTDNDLVPPLELCIRTNIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 3206 - protein, 26 aa, Homo sapiens
MKLLLWACIVCVAFARKNAGLGFLWL

SEQ ID NO: 3207 - protein, 115 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFS

SEQ ID NO: 3208 - protein, 54 aa, Homo sapiens
MYIPLDPDYNADCPNVTAPVCASNGHTFQNECFFCVEQREFHYRIKFEKYGKCD

SEQ ID NO: 3209 - protein, 116 aa, Homo sapiens
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQ

SEQ ID NO: 3210 - protein, 143 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISG

SEQ ID NO: 3211 - protein, 248 aa, Homo sapiens
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKSSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 3212 - protein, 120 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTL

SEQ ID NO: 3213 - protein, 112 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGK

SEQ ID NO: 3214 - protein, 170 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRA

SEQ ID NO: 3215 - protein, 138 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQ

SEQ ID NO: 3216 - protein, 94 aa, Homo sapiens; identical to SEQ ID NO: 2723

SEQ ID NO: 3217 - protein, 51 aa, Homo sapiens; identical to SEQ ID NO: 3179

SEQ ID NO: 3218 - protein, 919 aa, Homo sapiens; identical to SEQ ID NO: 2501

SEQ ID NO: 3219 - protein, 105 aa, Homo sapiens
MGVSKLDILYRRLLLTKLFIRGWGRPEDLKRLFEFRKMIGNRERCQNLVSSDYPVHIDKIEEQSDCKILDGHFVSPMAHYVPDIMPIESVIARFQFIVPKEWNSK

SEQ ID NO: 3220 - protein, 41 aa, Homo sapiens
MKLSGMFLLLSLALFCFLTGVFSQGGQVDCGEFQDPKVYCT

SEQ ID NO: 3221 - protein, 152 aa, Homo sapiens; identical to SEQ ID NO: 2696

SEQ ID NO: 3222 - protein, 536 aa, Homo sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 3223 - protein, 95 aa, Homo sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFI

SEQ ID NO: 3224 - protein, 70 aa, Homo sapiens
MASDLIRTILAVALISKLGTAVDAELMPSGAILQNKRENLPRVCHALAFLGMARCQDLFLVRLQGWKLGT

SEQ ID NO: 3225 - protein, 138 aa, Homo sapiens; identical to SEQ ID NO: 3215

SEQ ID NO: 3226 - protein, 72 aa, Homo sapiens
MAVSVLRLTVVLGLLVLFLTCYADDKPDKPDDKPDDSGKDPKPDFPKFLSLLGTEIIENAVEFILRSMSRST

SEQ ID NO: 3227 - protein, 145 aa, Homo sapiens
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYFISSSSPSGL

SEQ ID NO: 3228 - protein, 85 aa, Homo sapiens
MGPEALSSLLLLLLVASGDADMKGHFDPAKCRYALGMQDRTIPDSDISASSSWSDSTAARHSRLESSDGDGAWCPAGSVFPKEEE

SEQ ID NO: 3229 - protein, 469 aa, Homo sapiens
MLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 3230 - protein, 130 aa, Homo sapiens
MLPFLFFSTLFSSIFTEAQKQYWVCNSSDASISYTYCGRDLKQLYFNLYITVNTMNLPKRKEVICRGSDDDYSFCRALKGETVNTTISFSFKGIKFSKGKYKCVVEAISGSPEEMLFCLEFVILHQPNSN

SEQ ID NO: 3231 - protein, 105 aa, Homo sapiens
MKCTAREWLRVTTVLFMARAIPAMVVPNATLLEKLLEKYMDEDGEWWIAKQRGKRAITDNDMQSILDLHNKLRSQVYPTASNMEYMTWDVELERSAESWAESCLW

SEQ ID NO: 3232 - protein, 188 aa, Homo sapiens
MTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 3233 - protein, 424 aa, Homo sapiens
MPPFLITLFLFHSCCLRANGHLREGMTLLKTEFALHLYQSVAACRNETNFVISPAGVSLPLEILQFGAEGSTGQQLADALGYTVHDKRVKDFLHAVYATLPTSSQGTEMELACSLFVQVGTPLSPCFVEHVSWWANSSLEPADLSEPNSTAIQTSEGASRETAGGGPSEGPGGWPWEQVSAAFAQLVLVSTMSFQGTWRKRFSSTDTQILPFTCAYGLVLQVPMMHQTTEVNYGQFQDTAGHQVGVLELPYLGSAVSLFLVLPRDKDTPLSHIEPHLTASTIHLWTTSLRRARMDVFLPRFRIQNQFNLKSILNSWGVTDLFDPLKANLKGISGQDGFYVSEAIHKAKIEVLEEGTKASGATALLLLKRSRIPIFKADRPFIYFLREPNTGITVFFDRIQIIYQCLSSNKGSFVHYPLKNKHSF

SEQ ID NO: 3234 - protein, 604 aa, Homo sapiens
MAVLVCPASCHGLKEFRIRRGMWRLCLVYYFYPASSTLYVLRIDVLNYTSKDEGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 3235 - protein, 312 aa, Homo sapiens
MNIWGQIWPKAVYLVCNYSPKGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 3236 - protein, 258 aa, Homo sapiens; identical to SEQ ID NO: 1915

SEQ ID NO: 3237 - protein, 404 aa, Homo sapiens; identical to SEQ ID NO: 2740

SEQ ID NO: 3238 - protein, 311 aa, Homo sapiens; identical to SEQ ID NO: 3139

SEQ ID NO: 3239 - protein, 184 aa, Homo sapiens
MASERLPNRPACLLVASGAAEGVSAQSFLHCFTMASTAFNLQVATPGGKAMEFVDVTESNARWVQDFRLKAYASPAKLESIDEPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRK

SEQ ID NO: 3240 - protein, 418 aa, Homo sapiens; identical to SEQ ID NO: 2309

SEQ ID NO: 3241 - protein, 474 aa, Homo sapiens
MDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKVDLPLIDSLIRVLQNMEQCQKKPENSAESNTEETKRTDLTQDDFHLKILKDILCEFLSNIFQALTKETVAQGVKEGQLSKQKCSSAFQNLLPFYSPVVEDFIKILREVDKALADDLEKNFPSLKVQT

SEQ ID NO: 3242 - protein, 145 aa, Homo sapiens; identical to SEQ ID NO: 2075

SEQ ID NO: 3243 - protein, 575 aa, Homo sapiens
  MOD_RES (1)..(1): Any amino acid
XIFGGSIHYFRVPREYWRDRLLKMKACGLNTLTTYVPWNLHEPERGKFDFSGNLDLEAFVLMAAEIGLWVILRPGPYICSEMDLGGLPSWLLQDPGMRLRTTYKGFTEAVDLYFDHLMSRVVPLQYKRGGPIIAVQVENEYGSYNKDPAYMPYVKKALEDRGIVELLLTSDNKDGLSKGIVQGVLATINLQSTHELQLLTTFLFNVQGTQPKMVMEYWTGWFDSWGGPHNILDSSEVLKTVSAIVDAGSSINLYMFHGGTNFGFMNGAMHFHDYKSDVTSYDYDAVLTEAGDYTAKYMKLRDFFGSISGIPLPPPPDLLPKMPYEPLTPVLYLSLWDALKYLGEPIKSEKPINMENLPVNGGNGQSFGYILYETSITSSGILSGHVHDRGQVFVNTVSIGFLDYKTTKIAVPLIQGYTVLRILVENRGRVNYGENIDDQRKGLIGNLYLNDSPLKNFRIYSLDMKKSFFQRFGLDKWSSLPETPTLPAFFLGSLSISSTPCDTFLKLEGWEKGVVFINGQNLGRYWNIGPQKTLYLPGPWLSSGINQVIVFEETMAGPALQFTETPHLGRNQYIK

SEQ ID NO: 3244 - protein, 84 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGY

SEQ ID NO: 3245 - protein, 247 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYD

SEQ ID NO: 3246 - protein, 38 aa, Homo sapiens
MRTLFNLLWLALACSPVHTTLSKSDAKKAASKTLLEKV

SEQ ID NO: 3247 - protein, 249 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDE

SEQ ID NO: 3248 - protein, 66 aa, Homo sapiens
MKPLLVVFVFLFLWDPVLAGINSLSSEMHKKCYKNGICRLECYESEMLVAYCMFQLECCVKGNPAP

SEQ ID NO: 3249 - protein, 333 aa, Homo sapiens; identical to SEQ ID NO: 2641

SEQ ID NO: 3250 - protein, 214 aa, Homo sapiens
MRPKTGQVGCETPEELGPGPRQRWPLLLLGLAMVAHGLLRPMVAPQSGDPDPGASVGSSRSSLRSLWGRLLLQPSPQRADPRCWPRGFWSEPQSLCYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 3251 - protein, 349 aa, Homo sapiens
  MOD_RES (1)..(1): Any amino acid
XLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEQSCVNCGREAMSECTGCHKVNYCSTFCQRKRWSLTMLTSLVSISWLRAILPCQPPKVLGL

SEQ ID NO: 3252 - protein, 199 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPC

SEQ ID NO: 3253 - protein, 154 aa, Homo sapiens
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSV

SEQ ID NO: 3254 - protein, 311 aa, Homo sapiens; identical to SEQ ID NO: 1965

SEQ ID NO: 3255 - protein, 467 aa, Homo sapiens; identical to SEQ ID NO: 2319

SEQ ID NO: 3256 - protein, 26 aa, Homo sapiens
MRTLFNLLWLALACSPVHTTLSKSDA

SEQ ID NO: 3257 - protein, 182 aa, Homo sapiens
MRRMWATQGLAVALALSVLPGSRALRPGDCEVCISYLGRFYQDLKDRDVTFSPATIENELIKFCREARGKENRLCYYIGATDDAATKIINEVSKPLAHHIPVEKICEKLKKKDSQICELKYDKQIDLSTVDLKKLRVKELKKILDDWGETCKGCAEKSDYIRKINELMPKYAPKAASARTDL

SEQ ID NO: 3258 - protein, 50 aa, Homo sapiens
MKVFFLFAVLFCLVQTNSVHISHREARGPSFRICVDFLGPRWARGCSTGN

SEQ ID NO: 3259 - protein, 221 aa, Homo sapiens
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKP

SEQ ID NO: 3260 - protein, 418 aa, Homo sapiens; identical to SEQ ID NO: 2199

SEQ ID NO: 3261 - protein, 203 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNA

SEQ ID NO: 3262 - protein, 163 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINF

SEQ ID NO: 3263 - protein, 189 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRV

SEQ ID NO: 3264 - protein, 194 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGL

SEQ ID NO: 3265 - protein, 361 aa, Homo sapiens; identical to SEQ ID NO: 2968

SEQ ID NO: 3266 - protein, 108 aa, Homo sapiens
  MOD_RES (1)..(1): Any amino acid
XPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 3267 - protein, 167 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKR

SEQ ID NO: 3268 - protein, 402 aa, Homo sapiens; identical to SEQ ID NO: 2149

SEQ ID NO: 3269 - protein, 324 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQVRGGPA

SEQ ID NO: 3270 - protein, 329 aa, Homo sapiens; identical to SEQ ID NO: 1856

SEQ ID NO: 3271 - protein, 116 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRR

SEQ ID NO: 3272 - protein, 93 aa, Homo sapiens; identical to SEQ ID NO: 2525

SEQ ID NO: 3273 - protein, 84 aa, Homo sapiens
MRPKTGQVGCETPEELGPGPRQRWPLLLLGLAMVAHGLLRPMVAPQSGDPDPGASVGSSRSSLRSLWGRSAQGQPHCHSVPALL

SEQ ID NO: 3274 - protein, 8 aa, Homo sapiens
MSLDIQSL

SEQ ID NO: 3275 - protein, 191 aa, Homo sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRIT

SEQ ID NO: 3276 - protein, 40 aa, Homo sapiens
MSLDIQSLDIQCEELSDARWAELLPLLQQCQVVRLDDCGL

SEQ ID NO: 3277 - protein, 215 aa, Homo sapiens
MRPKTGQVGCETPEELGPGPRQRWPLLLLGLAMVAHGLLRPMVAPQSGDPDPGASVGSSRSSLRSLWGSRLLLQPSPQRADPRCWPRGFWSEPQSLCYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 3278 - protein, 332 aa, Homo sapiens
MCPAGWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 3279 - protein, 295 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMG

SEQ ID NO: 3280 - protein, 132 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQG

SEQ ID NO: 3281 - protein, 119 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGRE

SEQ ID NO: 3282 - protein, 129 aa, Homo sapiens; identical to SEQ ID NO: 1961

SEQ ID NO: 3283 - protein, 461 aa, Homo sapiens [sequence omitted]

SEQ ID NO: 3284 - protein, 150 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSS

SEQ ID NO: 3285 - protein, 418 aa, Homo sapiens; identical to SEQ ID NO: 2309

SEQ ID NO: 3286 - protein, 333 aa, Homo sapiens; identical to SEQ ID NO: 2641

SEQ ID NO: 3287 - protein, 328 aa, Homo sapiens
MCPAGWKLLAMLALVLVVMVWYSISREDSFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 3288 - protein, 194 aa, Homo sapiens; identical to SEQ ID NO: 1914

SEQ ID NO: 3289 - protein, 461 aa, Homo sapiens [sequence omitted]

SEQ ID NO: 3290 - protein, 664 aa, Homo sapiens
MPQAPSTGSSLIRDPSIAHRNTQILWTEAGRDLAQDTRYTGEESLTIFVDKRKLSKRAEGSDSTTNSSSVTLETLHQLAASYFIDRDSTLRRLHHIQIASTAIKVTETRTGPLGCSNYDNLDSVSSVLVQSPENKIQLQGLQVLLPDYLQERFVQAALSYIACNSEGEFICKENDCWCHCGPKFPECNCPSMDIQAMEENLLRITETWKAYNSDFEESDEFKLFMKRLPMNYFLNTSTIMHLWTMDSNFQRRYEQLENSMKQLFLKAQKIVHKLFSLSKRCHKQPLISLPRQRTSTYWLTRIQSFLYCNENGLLGSFSEETHSCTCPNDQVVCTAFLPCTVGDASACLTCAPDNRTRCGTCNTGYMLSQGLCKPEVAESTDHYIGFETDLQDLEMKYLLQKTDRRIEVHAIFISNDMRLNSWFDPSWRKRMLLTLKSNKYKSSLVHMILGLSLQICLTKNSTLEPVLAVYVNPFGGSHSESWFMPVNENSFPDWERTKLDLPLQCYNWTLTLGNKWKTFFETVHIYLRSRIKSNGPNGNESIYYEPLEFIDPSRNLGYMKINNIQVFGYSMHFDPEAIRDLILQLDYPYTQGSQDSALLQLLEIRDRVNKLSPPGQRRLDLFSCLLRHRLKLSTSEVVRIQSALQAFNAKLPNTMDYDTTKLCS

SEQ ID NO: 3291 - protein, 152 aa, Homo sapiens
MARDYDHLFKLLIIGDSGVGKSSLLLRFADNTFSGSYITTIGVDFKIRTVEINGEKVKLQIWDTAGQERFRTITSTYYRGTHGVIVVYDVTSAESFVNVKRWLHEINQNCDDVCRILDVQLHHGAGPPSKERQPGKTAAATTERCGEAHEEQ

SEQ ID NO: 3292 - protein, 231 aa, Homo sapiens
MLYIGIAEYFFKSASFAHFTAGVFNVTLSTEEISNHFVQNSQGLGNVLSRIAEIYILSQPFMVRIMATEPPIINLQPGNFTLDIPASIMMLTQPKNSTVETIVSMDFVASTSVGLVILGQRLVCSLSLNRFRLALPESNRSNIEVLRFENILSSILHFGVLPLANAKLQQGFPLSNPHKFLFVNSDIEVLEGFLLISTDLKYETSSKQQPSFHVWEGLNLISRQWRGKSAP

SEQ ID NO: 3293 - protein, 636 aa, Homo sapiens; identical to SEQ ID NO: 2224

SEQ ID NO: 3294 - protein, 457 aa, Homo sapiens
MGCSLPLSCIMVRSVAWAGFMVLLMIPWGSAAKLVCYFTNWAQYRQGEARFLPKDLDPSLCTHLIYAFAGMTNHQLSTTEWNDETLYQEFNGLKKMFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELSLPYLPSGTPELEVPKPGQPSEPEHGPSPGQDTFCQGKADGLYPNPRERSSFYSCAAGRLFQQSCPTGLVFSNSCKCCTWN

SEQ ID NO: 3295 - protein, 374 aa, Homo sapiens
MYVSTRERYKWLRFSEDCLYLNVYAPARAPGDPQLPVMVWFPGGAFIVGAASSYEGSDLAAREKVVLVFLQHRLGIFGFLRWRGRTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRETPMMGICPAGHATTRMKSTCSWILPQEWA

SEQ ID NO: 3296 - protein, 127 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMS

SEQ ID NO: 3297 - protein, 94 aa, Homo sapiens; identical to SEQ ID NO: 2593

SEQ ID NO: 3298 - protein, 137 aa, Homo sapiens
MAALSRALGPLRTPAPPLWIGLFLVATGSQQSLAQPLPGNTTEATPRSLRASGSLCGPHAKAPYLCEATHEPAAARIRAQVPDTRWSRVGGQRFYSRVLSPLHRGPSGHTEASAQRSHMGKLKEPQPQDHKPGLGAS

SEQ ID NO: 3299 - protein, 75 aa, Homo sapiens
MLKVHYPKFGVSEDCLYLNIYAPAHADTGSKLPVLVWFPGGAFKTGSASIFDGSALAAYEDVLVVVVQYRLGIFG

SEQ ID NO: 3300 - protein, 496 aa, Homo sapiens
MAPARTMARARLAPADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 3301 - protein, 175 aa, Homo sapiens
MPPGTRACRVPRPGRRAPRPRRDGEPGGHGVAPASAEEVGARPGLRAVARLLPQQHLQAGYVCERKDLLVNGCCNVNVPSTKQYCCDGCWPNGCCSAYEYCVSCCLQPNKQLLLERFLNRAAVAFQNLFMAVEDHFELCLAKCRTSSQSVQHENTYRDPIAKYCYGESPPELFPA

SEQ ID NO: 3302 - protein, 626 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGDQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLIVGILLVLMAVVLASLIYRRRLMKQDFSVPQLPHSSSHWLRLPRIFCSCPIGENSPLLSGQQV

SEQ ID NO: 3303 - protein, 536 aa, Homo sapiens
MPTLCSSFGLQVLLPEYLRERFVAAALSYITCSSEGELVCKENDCWCKCSPTFPECNCPDADIQAMEDSLLQIQDSWATHNRQFEESEEFQALLKRLPDDRFLNSTAISQFWAMDTSLQHRYQQLGAGLKVLFKKTHRILRRLFNLCKRCHRQPRFRLPKESSPRSLSYWWNRIQSLLYCGESTFPGTFLEQSHSCTCPYDQSSCQGPIPCALGEGPACAHCAPDNSTRCGSCNPGYVLAQGLCRPEVAESLENFLGLETDLQDLELKYLLQKQDSRIEVHSIFISNDMRLGSWFDPSWRKRMLLTLKSNKYKPGLVHVMLALSLQICLTKNSTLEPVMAIYVNPFGGSHSESWFMPVNEGSFPDWERTNVDAAAQCQNWTITLGNRWKTFFETVHVYLRSRIKSLDDSSNETIYYEPLEMTDPSKNLGYMKINTLQVFGYSLPFDPDAIRDLILQLDYPYTQGSQDSALLQLIELRDRVNQLSPPGKVRLDLFSCLLRHRLKLANNEVGRIQSSLRAFNSKLPNPVEYETGKLCS

SEQ ID NO: 3304 - protein, 140 aa, Homo sapiens
MSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLIDLKKRKEEEKRQQKGEA

SEQ ID NO: 3305 - protein, 372 aa, Homo sapiens
MAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 3306 - protein, 413 aa, Homo sapiens; identical to SEQ ID NO: 2399

SEQ ID NO: 3307 - protein, 846 aa, Homo sapiens; identical to SEQ ID NO: 2548

SEQ ID NO: 3308 - protein, 193 aa, Homo sapiens; identical to SEQ ID NO: 1844

SEQ ID NO: 3309 - protein, 270 aa, Homo sapiens
MHGSCSFLMLLLPLLLLLVATTGPVGALTDEEKRLMVELHNLYRAQVSPTASDMLHMRWDEELAAFAKAYARQCVWGHNKERGRRGENLFAITDEGMDVPLAMEEWHHEREHYNLSAATCSPGQMCGHYTQVVWAKTERIGCGSHFCEKLQGVEETNIELLVCNYEPPGNVKGKRPYQEGTPCSQCPSGYHCKNSLCEPIGSPEDAQDLPYLVTEAPSFRATEASDSRKMGAEGPDKPSVVSGLNSGPGHVWGPLLGLLLLPPLVLAGIF

SEQ ID NO: 3310 - protein, 233 aa, Homo sapiens
MDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDELEDVFLLETDNPRTTLVYGIFTTSSSVFKGSAVCVYHLSDIQTVFNGPFAHKEGPNHQLISYQGRIPYPRPGTNTCV

SEQ ID NO: 3311 - protein, 455 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGLVWLSAAMGFGNCVELQASAAFNWNNQRCKTRNRYICQFAQEHISRWGPGS

SEQ ID NO: 3312 - protein, 153 aa, Homo sapiens
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSDFMILWLHGENGTGPAKFNIPHSVT

SEQ ID NO: 3313 - protein, 124 aa, Homo sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQAPARRTGSGSVTKNHAWWIQT

SEQ ID NO: 3314 - protein, 258 aa, Homo sapiens [sequence omitted]

SEQ ID NO: 3315 - protein, 576 aa, Homo sapiens; identical to SEQ ID NO: 2667

SEQ ID NO: 3316 - protein, 452 aa, Homo sapiens
MADMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSCPPPPPPCPPPPPVSTISCSYESASRSSLFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 3317 - protein, 510 aa, Homo sapiens
MGRPTQWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 3318 - protein, 37 aa, Homo sapiens
MNSTLNFFIQSYNNASNDTYLYRVQRLIRSQMQQVHC

SEQ ID NO: 3319 - protein, 421 aa, Homo sapiens
MGRPTQWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 3320 - protein, 330 aa, Homo sapiens
MSSWSRQRPKSPGGIQPHVSRTLFLLLLLAASAWGVTLSPKDCQVFRSDHGSSISCQPPAEIPGYLPADTVHLAVEFFNLTHLPANLLQGASKLQELHLSSNGLESLSPEFLRPVPQLRVLDLTRNALVLKENQLEVLEVSWLHGLKALGHLDLSGNRLRKLPPGLLANFTLLRTLDLGENQLETLPPDLLRGPLQLERLHLEGNKLQVLGKDLLLPQPDLRYLFLNGNKLARVAAGAFQGLRQLDMLDLSNNSLASVPEGLWASLGQPNWDMRDGFDISGNPWICDQNLSDLYRWLQAQKDKMFSQNDTRCAGPEAVKGQTLLAVAKSQ

SEQ ID NO: 3321 - protein, 604 aa, Homo sapiens; identical to SEQ ID NO: 1834

SEQ ID NO: 3322 - protein, 315 aa, Homo sapiens [sequence omitted]

SEQ ID NO: 3323 - protein, 68 aa, Homo sapiens
MQVSTAALAVLLCTMALCNQVLSAPLAADTPTACCFSYTSRQIPQNFIADYFETSSQCSKPSVMAAPG

SEQ ID NO: 3324 - protein, 1122 aa, Homo sapiens
MSLQEMFRFPMGLLLGSVLLVASAPATLEPPGCSNKEQQVTVSHTYKIDVPKSALVQVDADPQPLSDDGASLLALGEAREEQNIIFRHNIRLQTPQKDCELAGSVQDLLARVKKLEEEMVEMKEQCSAQRCCQGVTDLSRHCSGHGTFSLETCSCHCEEGREGPACERLACPGACSGHGRCVDGRCLCHEPYVGADCGYPACPENCSGHGECVRGVCQCHEDFMSEDCSEKRCPGDCSGHGFCDTGECYCEEGFTGLDCAQVVTPQGLQLLKNTEDSLLVSWEPSSQVDHYLLSYYPLGKELSGKQIQVPKEQHSYEILGLLPGTKYIVTLRNVKNEVSSSPQHLLATTDLAVLGTAWVTDETENSLDVEWENPSTEVDYYKLRYGPMTGQEVAEVTVPKSSDPKSRYDITGLHPGTEYKITVVPMRGELEGKPILLNGRTEIDSPTNVVTDRVTEDTATVSWDPVQAVIDKYVVRYTSADGDTKEMAVHKDESSTVLTGLKPGEAYKVYVWAERGNQGSKKADTNALTEIDSPANLVTDRVTENTATISWDPVQATIDRYVVRYTSAKDGETREVPVGKEQSSTVLTGLRPGVEYTVHVWAQKGAQESKKADTKAQTDIDSPQNLVTDWVTENTATVSWDPVQATIDRYVVHYTSANGETREVPVGKEQSSTVLTGLRPGMEYTVHVWAQKGNQESKKADTKAQTEIDGPKNLVTDWVTENMATVSWDPVQATIDKYMVRYTSADGETREVPVGKEHSSTVLTGLRPGMEYMVHVWAQKGAQESKKADTKAQTELDPPRNLRPSAVTQSGGILTWTPPSAQIHGYILTYQFPDGTVKEMQLGREDQRFALQGLEQGATYPVSLVAFKGGRRSRNVSTTLSTVGARFPHPSDCSQVQQNSNAASGLYTIYLHGDASRPLQVYCDMETDGGGWIVFQRRNTGQLDFFKRWRSYVEGFGDPMKEFWLGLDKLHNLTTGTPARYEVRVDLQTANESAYAIYDFFQVASSKERYKLTVGKYRGTAGDALTYHNGWKFTTFDRDNDIALSNCALTHHGGWWYKNCHLANPNGRYGETKHSEGVNWEPWKGHEFSIPYVELKIRPHGYSREPVLGRKKRTLRGRLRTF

SEQ ID NO: 3325 - protein, 298 aa, Homo sapiens
MLHPETSPGRGHLLAVLLALLGTAWAEVWPPQLQEQAPMAGALNRKESFLLLSLHNRLRSWVQPPAADMRRLDWSDSLNWLKPGPLWNPNPEPGVRPVAHPASGLEHAACPRAWRPLLKWSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYEPSVPPRCIFPSTPVT

SEQ ID NO: 3326 - protein, 575 aa, Homo sapiens
MDLVLKRCLLHLAVIGALLAVGATKGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 3327 - protein, 109 aa, Homo sapiens
  MOD_RES (1)..(1): Any amino acid
XSGQSLKSLNASSGHLALILSSIFGLLLLVLFILFLTWCRVQKQKHLPLRVSTRRRGSLEENLFHEMETCLKREDPHGTRTSDDTPNHGCEDASDTSLLGVLPASEATK

SEQ ID NO: 3328 - protein, 103 aa, Homo sapiens [sequence omitted]

SEQ ID NO: 3329 - protein, 962 aa, Homo sapiens; identical to SEQ ID NO: 2516

SEQ ID NO: 3330 - protein, 303 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQARAALCGTPTPSLASGLWRTLQVGWNMQLLPAGLVSFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGEPSVPPRCIFPSTPVT

SEQ ID NO: 3331 - protein, 451 aa, Homo sapiens
MEATGTDEVDKLKTKFISAWNNMKYSWVLKTKTYFSRNSPVLLLGKCYHFKYEDEDKTLPAESGCTIEDHVIAGNVEEFRKDFISRIWLTYREEFPQIEGSALTTDCGWGCTLRTGQMLLAQGLILHFLGRAWTWPDALNIENSDSESWTSHTVKKFTASFEASLSGEREFKTPTISLKETIGKYSDDHEMRNEVYHRKIISWFGDSPLALFGLHQLIEYGKKSGKKAGDWYGPAVVAHILRKAVEEARHPDLQGITIYVAQDCTVYNSDVIDKQSASMTSDNADDKAVIILVPVRLGGERTNTDYLEFVKGILSLEYCVGIIGGKPKQSYYFAGFQDDSLIYMDPHYCQSFVDVSIKDFPLETFHCPSPKKMSFRKMDPSCTIGFYCRNVQDFKRASEEITKMLKFSSKEKYPLFTFVNGHSRDYDFTSTTTNEEDLFSEDEKKQKKKKK

SEQ ID NO: 3332 - protein, 518 aa, Homo sapiens
MRTWDYRWSLALVAQTGVHCCNLSSLQPLPPRFKRFSCLSLSSGWDYSNSGNMKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW
